United States Patent 11,446,398 (REGULATED BIOCIRCUIT SYSTEMS) - sequence listing, part 34

SEQ ID NO: 118627 - DNA, 2162 bp, Homo sapiens
  Payload ID: 3219
  Gene Symbol: C18orf8
  Gene Name: chromosome 18 open reading frame 8
  Uniprot ID: Q96DM3
  ENST ID: ENST00000269221
  CDS Start-End: 111-2084
ccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaa

SEQ ID NO: 118628 - DNA, 2102 bp, Homo sapiens
  Payload ID: 3219
  Gene Symbol: C18orf8
  Gene Name: chromosome 18 open reading frame 8
  ENST ID: ENST00000590870
  CDS Start-End: 87-1088
ctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctaatttcctataacatgtggattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaag

SEQ ID NO: 118629 - DNA, 787 bp, Homo sapiens
  Payload ID: 3219
  Gene Symbol: C18orf8
  Gene Name: chromosome 18 open reading frame 8
  ENST ID: ENST00000589860
  CDS Start-End: 89-289
cgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcagg

SEQ ID NO: 118630 - DNA, 2002 bp, Homo sapiens
  Payload ID: 3219
  Gene Symbol: C18orf8
  Gene Name: chromosome 18 open reading frame 8
  ENST ID: ENST00000590868
  CDS Start-End: 101-1930
agccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaact

SEQ ID NO: 118631 - DNA, 660 bp, Homo sapiens
  Payload ID: 3219
  Gene Symbol: C18orf8
  Gene Name: chromosome 18 open reading frame 8
  ENST ID: ENST00000587690
  CDS Start-End: 100-564
gccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagggcggactctttggtgaggagaggtgcatccccaccactgtcctgcctgccctgcagtggccccgtgtgaagagaccctcagcccggcccttctcaaacctgtctgccctcaagcgagtcggactaagaatgccaacattctaggattctgctggactagttcaactgaaattgtcttcataacagatcaaggaatcgaattttaccaggtattaccagagaaacggagtctgaaactct

SEQ ID NO: 118632 - DNA, 1945 bp, Homo sapiens
  Payload ID: 3219
  Gene Symbol: C18orf8
  Gene Name: chromosome 18 open reading frame 8
  ENST ID: ENST00000589215
  CDS Start-End: 107-364
agccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttaggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactat

SEQ ID NO: 118633 - DNA, 1958 bp, Homo sapiens
  Payload ID: 3219
  Gene Symbol: C18orf8
  Gene Name: chromosome 18 open reading frame 8
  ENST ID: ENST00000615148
  CDS Start-End: 150-1835
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagcctttgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctc

SEQ ID NO: 118634 - DNA, 2464 bp, Homo sapiens
  Payload ID: 3220
  Gene Symbol: C19orf12
  Gene Name: chromosome 19 open reading frame 12
  Uniprot ID: Q9NSK7
  ENST ID: ENST00000323670
  CDS Start-End: 141-566
gggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcag

SEQ ID NO: 118635 - DNA, 578 bp, Homo sapiens
  Payload ID: 3220
  Gene Symbol: C19orf12
  Gene Name: chromosome 19 open reading frame 12
  ENST ID: ENST00000342680
  CDS Start-End: 162-368
cggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttggatccagtctaagacaccgcattgcattgaatcgcctgctttcttagtctcctctggcctttaacactttctcagacttgccttgttcacagccttgatagttttgaggagtactgggcagggggggctgtcggggggctgttaggtgcctggatgacaagtggacagtttaagccggttcctcagatcctaatggagctgccccctgccgagcaacagaggctctttaacgaagccgcagccatcatcaggcacct

SEQ ID NO: 118636 - DNA, 1912 bp, Homo sapiens
  Payload ID: 3220
  Gene Symbol: C19orf12
  Gene Name: chromosome 19 open reading frame 12
  Uniprot ID: Q9NSK7
  ENST ID: ENST00000392276
  CDS Start-End: 130-363
gggctggggagctgggcggggagcccggggcctgccaggcccgggctgcagccgcgtctgatcgccgagcgcgccgcgtagacctccgctcccccagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaa

SEQ ID NO: 118637 - DNA, 895 bp, Homo sapiens
  Payload ID: 3220
  Gene Symbol: C19orf12
  Gene Name: chromosome 19 open reading frame 12
  Uniprot ID: Q9NSK7
  ENST ID: ENST00000392278
  CDS Start-End: 128-586
caagagcaggcctggagacccgggagtgccttggggagagggtccccgccctgccgggagcccggccctcccggtgccggggtggacactgttagtgtagtcattgtccctatggagaaactgaggcatggagaggctgaagtcacacaagcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccg

SEQ ID NO: 118638 - DNA, 1504 bp, Homo sapiens
  Payload ID: 3220
  Gene Symbol: C19orf12
  Gene Name: chromosome 19 open reading frame 12
  Uniprot ID: Q9NSK7
  ENST ID: ENST00000592153
  CDS Start-End: 111-434
gcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacaca

SEQ ID NO: 118639 - DNA, 546 bp, Homo sapiens
  Payload ID: 3220
  Gene Symbol: C19orf12
  Gene Name: chromosome 19 open reading frame 12
  ENST ID: ENST00000591243
  CDS Start-End: 228-546
actcagctgctgctatttgcttattcactaactgctgcctgtcctgtctgtgggaactttccaccgtctggatgctgtctgtcatacaggcgcttggagctgctgagctttcctgaaaagggggacccttccttaaaactctaggaactagagtggcattgtgatggaaatactcttatgctcattgaaactgtccctctgaacttctccctcgaaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagc

SEQ ID NO: 118640 - DNA, 4489 bp, Homo sapiens
  Payload ID: 3220
  Gene Symbol: C19orf12
  Gene Name: chromosome 19 open reading frame 12
  Uniprot ID: Q9NSK7
  ENST ID: ENST00000614091
  CDS Start-End: 238-663
acccaacctgcttctccttttgcaacccccagacccagaggctccagagcaggctctggaacagaggaaatctggctccggcccacacattcaccaaatactgacgcagcacccttgacctccagatgcccctgtgctctcttctgtgcccaggctgcggggagagaggggtcctccaggccaaagggagggaggtctccgggaggtccccgcggtcctggaggcaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcacttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcctatgccgaccccagaggcagccactgttaccaatttcatgtgtattcctttaactctgttttaaagtaagtctctgaaaactgttcatttccttttgtcagtatttgttgctgaaaacctagaaaaacccagaaaatataatgaaataaaaactacaaatttcacaacccagaaaactgctggtaacagatttggtgtctttcctgcaattgttttaatgctatgtaggtacacatatatttttttctttttttcttttttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttagccaggatggtctcaatctccttacctcgtgatctgcccacctcagcctcccaaagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggtatatagtctttgggattcattcctcaaagtgaaattgctggatttaaaagta

SEQ ID NO: 118641 - DNA, 4242 bp, Homo sapiens
  Payload ID: 3220
  Gene Symbol: C19orf12
  Gene Name: chromosome 19 open reading frame 12
  Uniprot ID: Q9NSK7
  ENST ID: ENST00000623113
  CDS Start-End: 183-416
caagagcaggcctggagacccgggagtgccttggggagagggtccccgccctgccgggagcccggccctcccggtgccggggtggacactgttagtgtagtcattgtccctatggagaaactgaggcatggagaggctgaagtcacacaaggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcacttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcctatgccgaccccagaggcagccactgttaccaatttcatgtgtattcctttaactctgttttaaagtaagtctctgaaaactgttcatttccttttgtcagtatttgttgctgaaaacctagaaaaacccagaaaatataatgaaataaaaactacaaatttcacaacccagaaaactgctggtaacagatttggtgtctttcctgcaattgttttaatgctatgtaggtacacatatatttttttctttttttcttttttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttagccaggatggtctcaatctccttacctcgtgatctgcccacctcagcctcccaaagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggtatatagtctttgggattcattcctcaaagtgaaattgctggatttaaaagta

SEQ ID NO: 118642 - DNA, 915 bp, Homo sapiens
  Payload ID: 3221
  Gene Symbol: C19orf18
  Gene Name: chromosome 19 open reading frame 18
  Uniprot ID: Q8NEA5
  ENST ID: ENST00000314391
  CDS Start-End: 103-750
agtagaacttcttgattcctcagataaatagaggacagatgctggactgtagctaagtatttcctttcatctacgggataaaatactgataatttgagagtgatggacaaggttcagagtggtttcctcattttgtttttgtttttaatggaatgccaacttcatttatgcttgccgtatgcagatggactccatcccactggaaacataacaggcttaccaggcagtaaacggtcacaaccacccagaaacatcaccaaagagcccaaagtgttctttcataaaacccagttgcctgggattcaaggggctgcctcgagatccacggctgcatcccctacgaaccccatgaaattcctgaggaataaagcaataattcggcatagacctgctcttgttaaagtaattttaatttcgagcgtagccttcagcattgccctgatatgtgggatggcaatctcctatatgatatatcgactggcacaggctgaggaaagacaacagctcgagtcactttataagaacctcaggataccgttattaggagatgaagaagagggctcagaggacgagggtgagtccacgcacctacttccagagaacgaaaatgagctggaaaagttcatccactcagttattatatcaaaaagaagcaaaaatattaagaagaaactgaaggaagagcaaaactcagtaacagaaaacaaaacaaagaatgcgtcacataatggaaaaatggaagacttgtgaacgcagacgacagaggtgccggctgaggcagaggagaaactatgggggtgctgggagactgagcctgtgggcgtggcttgctcccagagaaccttatggaagaggacatcaaagaaagaaatgccagacctgtatcccagaaaataaagccacatgatatagcaa

SEQ ID NO: 118643 - DNA, 983 bp, Homo sapiens
  Payload ID: 3222
  Gene Symbol: C19orf24
  Gene Name: chromosome 19 open reading frame 24
  Uniprot ID: Q9BVV8
  ENST ID: ENST00000409293
  CDS Start-End: 113-511
gcggggcccggcgtcaagctccgcctccgcgccccattggctggcatcacctccgcgcgcctgactgacagcgcgcataggggcggggcgccgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtgtttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgcagctggtgctgaccccatgcca

SEQ ID NO: 118644 - DNA, 668 bp, Homo sapiens
  Payload ID: 3222
  Gene Symbol: C19orf24
  Gene Name: chromosome 19 open reading frame 24
  ENST ID: ENST00000469144
  CDS Start-End: 235-633
acccgctctccagcctgcgcctggggttggaggtgcccagcgcgccgcctcttaactcgggggtgacgctgcccgtttcccaggttgaagaagcctcagcggaggcgatacggcctcctcgccaacactgaggaccccacggagatggcctcgctggacagcgacgaggagacggtgtttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgcagctggtgctgacccca

SEQ ID NO: 118645 - DNA, 1410 bp, Homo sapiens
  Payload ID: 3223
  Gene Symbol: C19orf25
  Gene Name: chromosome 19 open reading frame 25
  ENST ID: ENST00000427685
  CDS Start-End: 57-533
cggaatcggaagtggctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaaggtagggggagcccggtcccggggaaaagcggacctgagaccccggcagcaaggggacgggagagaagcacacccctaactcctgaccccacgccctgggaacccccgcaacatgggcacgaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtg

SEQ ID NO: 118646 - DNA, 2403 bp, Homo sapiens
  Payload ID: 3223
  Gene Symbol: C19orf25
  Gene Name: chromosome 19 open reading frame 25
  Uniprot ID: Q9UFG5
  ENST ID: ENST00000436106
  CDS Start-End: 216-572
cagaggttgagccagaccctgaagccttggccaccgtgtttttgggcggagggagggtcagggcctggggcgagctcagaggggcgggacagggcgggcttccccgggagcgggaccgcgacgggtgcgtacgagttcgctgggcgggaggagcagcccgggcaagggcggagaggtggacgccccggtcagcgcccccttccccgccttcagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggaca

SEQ ID NO: 118647 - DNA, 2128 bp, Homo sapiens
  Payload ID: 3223
  Gene Symbol: C19orf25
  Gene Name: chromosome 19 open reading frame 25
  ENST ID: ENST00000588871
  CDS Start-End: 35-517
gtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcgg

SEQ ID NO: 118648 - DNA, 1472 bp, Homo sapiens
  Payload ID: 3223
  Gene Symbol: C19orf25
  Gene Name: chromosome 19 open reading frame 25
  ENST ID: ENST00000588849
  CDS Start-End: 14-274
cccgccttcagagatgggctccaaggcaaagaagcgcgtgctgctgcccacccgcccagcgccccccacggtggagcagatcctggaggatgtgcggggtgcgccggcagaggatccagtgttcaccatcctggccccggaagagatgggggtgtcactatgttgtccaggctggtctctaactcttgggctcaagtgttcctcccgcctcggcctcccaaagtgctggattacaggcgtgagccaccacacctggctgcatccgtcatgttaagaagaccccggctggcaagctcactcggggactgcagggaaccctgccctttgggggcagtagtgaggggtgcccaggaggatggggtggtcagcaggcagtgatgctgctgtgtcctgtctcagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaag

SEQ ID NO: 118649 - DNA, 1265 bp, Homo sapiens
  Payload ID: 3223
  Gene Symbol: C19orf25
  Gene Name: chromosome 19 open reading frame 25
  Uniprot ID: Q9UFG5
  ENST ID: ENST00000586564
  CDS Start-End: 45-401
tttcgggtcccgcgcccaggtgggaagaggccggcgactgggagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggc

SEQ ID NO: 118650 - DNA, 1287 bp, Homo sapiens
  Payload ID: 3223
  Gene Symbol: C19orf25
  Gene Name: chromosome 19 open reading frame 25
  Uniprot ID: Q9UFG5
  ENST ID: ENST00000592872
  CDS Start-End: 73-429
gctttcgggtcccgcgcccaggtgggaagaggccggcgactggggtgaccgcggggaaactgaggcagagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtg

SEQ ID NO: 118651 - DNA, 853 bp, Homo sapiens
  Payload ID: 3223
  Gene Symbol: C19orf25
  Gene Name: chromosome 19 open reading frame 25
  ENST ID: ENST00000588427
  CDS Start-End: 42-257
ctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaaggctggagtgcagtggcgagatctcgactcactgcaggctccgactccccagttcaagcgattctcctgcctcagcctccggagtagctgggactacagacacccgccaccacgcccggctaattttttgtatttttagtagagacggggtttcaccgtgttagccaggatggtctcgatctcctgaccttgtgatccgcccgcctcggcctcccaaagtgctgggattacaggcaagagccaccgcgcccggcccagtgaggttgtttttttgagacgcagtcttgctctgtggcccaggctggaatgcagtggcgcaacctccgcctcctaggttcaagtgattctcctgcctcagcctcccgagtagctggactaacaggcgcccgctgccacgcctggctgttttttttagtagagatggggtctgaccatgttggccaggctggtctcgaactcctgacctcaagtgagccacggcgcccagcccacatttgctttcaaagagcagtgacatgaggagtgagccccagccggtctgaggctggaccacccgctaagcagtgagctgttcaacttgatttcctcccaagtcggagagctcgcccgctgccgccagcagtctccttccagtgactgaagaagcatccctgccgcccaccgggtgcccaccttggtggccc

SEQ ID NO: 118652 - DNA, 885 bp, Homo sapiens
  Payload ID: 3223
  Gene Symbol: C19orf25
  Gene Name: chromosome 19 open reading frame 25
  ENST ID: ENST00000590621
  CDS Start-End: 1-129
tccaaggcaaagaagcgcgtgctgctgcccacccgcccagcgccccccacggtggagcagatcctggaggatgtgcggggtgcgccggcagaggatccagtgttcaccatcctggccccggaaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaa

SEQ ID NO: 118653 - DNA, 1837 bp, Homo sapiens
  Payload ID: 3223
  Gene Symbol: C19orf25
  Gene Name: chromosome 19 open reading frame 25
  Uniprot ID: Q9UFG5
  ENST ID: ENST00000585675
  CDS Start-End: 397-753
gtgttccggccgccgagtgctcatgcaccaccaggctcccttaggtggacagcaattttgtgctcccgtcagccacatgggtggcgtgtcccctagtgccgtgttccccttttcagaaagacgagcctcggatgcttttctacccagccagtggagcctggactcgaactcgctctcatcgtagcgcgtccaggttcgggttcgcctgagaggctgagatccgagtctcaagggcactatccctttaagacggggcggagccccgcgatgagcggcgggccggcgggagaggaggccggaagtgtgtgtcacgtgttcggggacggggcggtgctccgaccggaatcggaagtggctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgctgaggcagaggtgtgagctcctgcagcgagccggcgaggacctggagcgggaggtggcccagatgaagcaggcagcattaccggcagccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaa

SEQ ID NO: 118654 - DNA, 574 bp, Homo sapiens
  Payload ID: 3223
  Gene Symbol: C19orf25
  Gene Name: chromosome 19 open reading frame 25
  ENST ID: ENST00000591027
  CDS Start-End: 54-290
aatcggaagtggctgcgtcgtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaaggtgatgacagaggtgatttgatcagcccagacccgtgcggcacgtggagccttcgtccgtgggagaccacactgccgaggggcaggccagagccgaggggcccctgacgcttctctgagtgaccctgaagtcggtgctgcttcagccctgctgcactgggcttgcatacgtgggggagcagggagccatacgtagtttctgctgaatgtgggagtcaccaggacgtcaatgcccacctctcaccttcgccacccctgcctccctaagtgtgtgctccaggaggttgcacggcccctggagaggttttcggtggcgggcttgttgcgtctctggcttccagagacagcaggaatgagagccaggccagctcagtggagtccatcccggtggg

SEQ ID NO: 118655 - DNA, 467 bp, Homo sapiens
  Payload ID: 3224
  Gene Symbol: C19orf33
  Gene Name: chromosome 19 open reading frame 33
  Uniprot ID: Q9GZP8
  ENST ID: ENST00000301246
  CDS Start-End: 102-422
agcattcctccaacgggcaggtctcagcgctcctccccctgctccgctcctctgcagggcccaggcgcccttggccttaggacccaacttctcttaccgccatggagttcgacctgggagcagccctggagcccacctcccagaagcccggtgtgggggcgggccacgggggagatcccaagctcagtccccacaaagttcagggccggtcggaggcaggggcaggtccgggtccaaagcaaggacaccacagctcttccgactccagcagcagctccagcgattcggacacggatgtgaagtcccacgctgctggctccaagcagcacgagagcatcccgggcaaggccaagaagcccaaagtgaagaagaaggagaagggcaagaaggagaagggcaagaagaaggaggctccccactgaagggccctggacagggctcattaaaccttcctctctgccttctgc

SEQ ID NO: 118656 - DNA, 520 bp, Homo sapiens
  Payload ID: 3224
  Gene Symbol: C19orf33
  Gene Name: chromosome 19 open reading frame 33
  Uniprot ID: Q9GZP8
  ENST ID: ENST00000588605
  CDS Start-End: 99-356
attcctccaacgggcaggtctcagcgctcctccccctgctccgctcctctgcagggcccaggcgcccttggccttaggacccaacttctcttaccgccatggagttcgacctgggagcagccctggagcccacctcccagaagcccggtgtgggggcgggccacgggggagatcccaagctcagtccccacaaagttcagggccggtcggaggcaggggcaggtccgggtccaaaggcctccaacttcagggggctgggtaaggggcgccgcctcactgccgcacctccatccagcaaggacaccacagctcttccgactccagcagcagctccagcgattcggacacggatgtgaagtcccacgctgctggctccaagcagcacgagagcatcccgggcaaggccaagaagcccaaagtgaagaagaaggagaagggcaagaaggagaagggcaagaagaaggaggctccccactgaagggccctggacagggctcattaaaccttcctctctgccttc

SEQ ID NO: 118657 - DNA, 2574 bp, Homo sapiens
  Payload ID: 3225
  Gene Symbol: C19orf35
  Gene Name: chromosome 19 open reading frame 35
  Uniprot ID: Q6ZS72
  ENST ID: ENST00000342063
  CDS Start-End: 95-1516
cagacccctcctgcgaggccaggggctgtggccattgggagtttgtccccacggacccctcctcccccagagggcacgccagtcttgaagcaacatgagcagcccggagccccccacagagccccccgagcccgacaaccccacctggtcgactcagcccacgtatagcaaccttggtcagatccgtgcccacctgctgccctccaaggcctgccgcctccggacccctgggtccctctccaccaacccagagcccctgcccccacccctgcccaagaagatcctaacccggacccagtcactgcccacccgcaggaccctccatcccagctccatccaagtacagccgcctcggagaccctttctggggtcccacagtgtggacaagagccaggctgcagtgggaccagcctgtctccctgcagagctgacctttggcccggctgacgccccactgggcctctccctccgcgatctgcacagcccggaggctgtgcacactgcactggctgcgcggcagctgcagggcctccgtaccatctatgcccggctccgtgcccggctcatggggggccaccccgggccctgccaccccggccacagcttccgcctcctagacagctcaccctgcgcagagagcggggacgccctgtattaccgcgtggtgcgcgcgcacgaggacgcctggcacatcctggtcgccaaggtgcccaagcccggggcggacgtgccccacccgtggggcctggagctgcaggcctccctgtctccacacttcaatctgcaggggctgtgtggcctggtgcctgaaggcacactgcccggggcgccctggagaggcgcagtggcgctggcagccgaggttccagagcgcacggtggcgcagtggctggcggaggcctgcacgcagccgccggaggagttcgtgtgggctgtggccctgctgctgctgcagctgagcgcggccctgaagttcctggaggcgtggggcgcggccctagtcgagttgcggccggagaacttgctgctggtggcacctcggggctgtgcgacgacggggcccccacgcctgctcctcactgactttggccgcgtctgtctgcagccccctggacccccgggatccccgggcccccacgcgccgcagctgggcagcctcctccgagcgctgctcagccttgctgcgccctcgaccacgcctttggccgcgggcctggagctcctggcagcacagctgacccgcttgcggccctcggcgtcccggacgcggggcgcgctgcaggcgctgctctgggggcccgggcctgagctgcgcggccgcggagcaccgcttggtccctggctccgagcgctcgggccctggctgcgggtgcgccgcgggctgctggtcctgcgcctagcagagcgggccgcaggtggggaagctcccagcctcgaggactggctgtgttgcgaatacctggccgaggccaccgagtcctcgatgggccaggccctggcgctgctgtgggactgaccccaacccagggcgaacacacctggtccaggcctgcccaggaggcagggctggggctgaggtcagcgtctccatgatagccaagacaccctcttcctgcagagtccaggagcgcagcagagagagcaatgccccactccagagcctcccctcccgtgctggggatgtgggtcaagggcttcccaggaatgcagctgcccctccagggctgggggctggccagcgcctcctgtgttgggcagcagctctctgaagccagggcccccacgccacttccaggtgtggacaaccccgctgatcaatgtctctctgtgttctgccttccccagcagccagggcgctcttccgcgtgggttctgtcattgtctccatgagaggccaatgccgggaccagaggcattcctggctctggagcacccccttgtgctgaagatggccagtgattttgggcatgtgaatgcccctgtccctggtggagaattgcttggtggtgtcacgggaagggaaggctccctgggaccttagacacccagctcatctcagcggggtctggactcaccttccctaaaacagtccccgcggttccctgccacctcccctcaatccctctgcgcccaccctgcctccctccctgttcctccgtgacacaccaacttctttcgcgcccccaagcatttgtgtaggctgttccctctgccatactgttccagttccactttctttttcttttttttttttttttttttttgagacgatctcggcttactgcaagctccgcctcccgggttcacgccattctcctgcctcagcctcccgagtagctgggactacaggcgcccgccaccacgcccggctaattttttgtatttttagtagagacggggtttctccgtgttagccaggatggtctccatctcctgacctcgtgatccgtccgcctcggcctcccaaagtgctgggattacaggcgtgagccaccgcgcccggctacagtttcactttctctaaacaaataaaggtgcccactctgggccatcgctagctccttaccctgcgtt

SEQ ID NO: 118658 - DNA, 1223 bp, Homo sapiens
  Payload ID: 3226
  Gene Symbol: C19orf38
  Gene Name: chromosome 19 open reading frame 38
  Uniprot ID: A8MVS5
  ENST ID: ENST00000397820
  CDS Start-End: 108-800
atcagccctggttctcctttccccgatctggcctcacaggaggagttggcggggagccttgggcccctctggcctcagccggatttcccagccaaacgcagagagagatgccctggaccatcttgctctttgcagctggctccttggcgatcccagcaccatccatccggctggtgcccccgtacccaagcagccaagaggaccccatccacatcgcatgcatggcccctgggaacttcccgggggcgaatttcacactgtatcgaggggggcaggtggtccagctcctgcaggcccccacggaccagcgcggggtgacatttaacctgagcggcggcagcagcaaggctccagggggacccttccactgccagtatggagtgttaggtgagctcaaccagtcccagctgtcagacctcagcgagcccgtgaacgtctccttcccagtgcccacttggatcttggtgctctccctgagcctggctggtgccctcttcctccttgctgggctggtggctgttgccctggtggtcagaaaagttaaactcagaaatttacagaagaaaagagatcgagaatcctgctgggcccagattaacttcgacagcacagacatgtccttcgataactccctgtttaccgtctccgcgaaaacgatgccagaagaagacccggccaccttggatgatcactcaggcaccactgccacccccagcaactccaggacccggaagaggcccacttccacgtcctcctcgcctgagacccccgaattcagcactttccgggcctgccagtgaggctgaggactgggggacccctctgtctccaggcattcgggggcctgaggtccctccagctacttctgggggggctctgtcagccactttctcagggaattggacagaggaaaggaaggggaaccctggccttgggattttcatcacagaggagtgggagaggggacacaggcatgggcctggcactatacagacaacaggaagttcccctctcgaccttcggctcctcaggaccaccagagaaggagatgtcaggaccccttcttgtcccccagctgggccataagacgtcccaggtctctgcacacccgtggaattcctcccttccccagtgggtttttgagcatagggtgcccttgggtgtgttgtgtgtctgcctgctggcttgcttaagttattaattataacacgggtcaaggtgtt

SEQ ID NO: 118659 - DNA, 1060 bp, Homo sapiens
  Payload ID: 3226
  Gene Symbol: C19orf38
  Gene Name: chromosome 19 open reading frame 38
  Uniprot ID: A8MVS5
  ENST ID: ENST00000592854
  CDS Start-End: 265-957
ttggcgggaccgacgtggtggagtggacccaaaaatagcgtctaggcgtggccctgtacgcgacccgtagggctcgcctataaaagggctggggcggggcggagatacctgtggcgtcgtgttttgcttgctctgtgagcgtggtccaggttcgacgccttttgcgccttagaggcatcagcgtatcagtttcctcgaggagttggcggggagccttgggcccctctggcctcagccggatttcccagccaaacgcagagagagatgccctggaccatcttgctctttgcagctggctccttggcgatcccagcaccatccatccggctggtgcccccgtacccaagcagccaagaggaccccatccacatcgcatgcatggcccctgggaacttcccgggggcgaatttcacactgtatcgaggggggcaggtggtccagctcctgcaggcccccacggaccagcgcggggtgacatttaacctgagcggcggcagcagcaaggctccagggggacccttccactgccagtatggagtgttaggtgagctcaaccagtcccagctgtcagacctcagcgagcccgtgaacgtctccttcccagtgcccacttggatcttggtgctctccctgagcctggctggtgccctcttcctccttgctgggctggtggctgttgccctggtggtcagaaaagttaaactcagaaatttacagaagaaaagagatcgagaatcctgctgggcccagattaacttcgacagcacagacatgtccttcgataactccctgtttaccgtctccgcgaaaacgatgccagaagaagacccggccaccttggatgatcactcaggcaccactgccacccccagcaactccaggacccggaagaggcccacttccacgtcctcctcgcctgagacccccgaattcagcactttccgggcctgccagtgaggctgaggactgggggacccctctgtctccaggcattcgggggcctgaggtccctccagctacttctgggggggctctgtcagccactttctcagggaattgg

SEQ ID NO: 118660 - DNA, 970 bp, Homo sapiens
  Payload ID: 3227
  Gene Symbol: C19orf43
  Gene Name: chromosome 19 open reading frame 43
  Uniprot ID: Q9BQ61
  ENST ID: ENST00000242784
  CDS Start-End: 119-649
cgctggagggcctgaccgctcttcccggcatgcattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 118661 - DNA, 841 bp, Homo sapiens
  Payload ID: 3227
  Gene Symbol: C19orf43
  Gene Name: chromosome 19 open reading frame 43
  ENST ID: ENST00000588213
  CDS Start-End: 15-413
cacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccg

SEQ ID NO: 118662 - DNA, 783 bp, Homo sapiens
  Payload ID: 3227
  Gene Symbol: C19orf43
  Gene Name: chromosome 19 open reading frame 43
  ENST ID: ENST00000592273
  CDS Start-End: 10-462
ggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 118663 - DNA, 988 bp, Homo sapiens
  Payload ID: 3227
  Gene Symbol: C19orf43
  Gene Name: chromosome 19 open reading frame 43
  ENST ID: ENST00000591254
  CDS Start-End: 1-402
atggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 118664 - DNA, 3427 bp, Homo sapiens
  Payload ID: 3228
  Gene Symbol: C19orf44
  Gene Name: chromosome 19 open reading frame 44
  Uniprot ID: Q9H6X5
  ENST ID: ENST00000221671
  CDS Start-End: 157-2130
accccgcgattgtgattcggggcgccattggtctgcggggcgcggtgcttcccgggagatgtagtctcttctgctctggctctgttgcccagggcaaccgctccttcaggcgtgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggtggccagcatggcagccatggggcctgccctgggaggcgcctacgtggacccgacacccatcgccaatcatgttatcagtgcagatgcaatagaagccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagcaaagcaccgcagcttcccagagttaccagcgcagcacttaagacaggatcttacggcggggtggggctcctggaccgtgaccggcgtcttcttcctggggagtacgacttggaccgggaccgcgactgggaccgggagcggcttctggaggagcgcgacctgctccgacttctgcagggaagggtgcccaagggtcagcagcagccaggcgtcgtggggaggccacaggaagaggcctcaggcactgccctgaggcagcctctgcctacctagatctggagcgggagtaggaacgggagcaggagcgcgaccttgaccttgagtacgagcctgaagacttggaggatcttgagttggagcgggaggaagaacgccctcgactcttggatctgctccgagacctcgagggtccgctgtggggagaggcctgatgatcaggtgccccagtggatgggctgcacccagcccaccctggccctcaggttcctagaccaccccagatgcaggggctctggctgtggatgtggcgccatagccacagcaacggtaccaagttcctaaatagtgtggccgagcctgctgctgtgtgaattcaggccttgtggaaaacaccgccccataggcacaggctgtgtgagggtggacgtgatgagtgtatctggggtctgctcccacccatcacaagctgtggaccctggccccccggccactgcagacatctgcgcttttacctgttcctcttctcctggcctttcctccgccgggcccgcatttttgctcggaagaactcatagaggccgttctgctcccagccttcactgtaagacacggcattccgtgtgtgaccacgtgacacccacccacaaggaagtcgtgaaaaagtcatcaggagttaatccacagaaccttggagagtacatggccctgtggctgtgggctccgagcatgggcgcagtagagcttggttcagtgttcccacagggctgtcctcctgcagcccagtggctcctctggtgcccacgcccttgccaccctgctgttccgctgaggtggtggggacccatggtctgtggaactgggaaacaggaacactgactcatgggtggacaggcctgcagcccagcacaggaaggaggggtgaccactgggaagggtgggctgagggccctgtggcagccggctgcttgagacgtgccgccgtgccacaccttccctaacttcttctgatgtgtctccattaaaacgcccttcattga

SEQ ID NO: 118665 - DNA, 569 bp, Homo sapiens
  Payload ID: 3228
  Gene Symbol: C19orf44
  Gene Name: chromosome 19 open reading frame 44
  ENST ID: ENST00000599550
  CDS Start-End: 386-569
gtgggaagaggtcggcagggctggtggggaggtgacctagctgggcgtccgggctcgcgagggggatacggggaaatggggccttctccggggctgagctggttgggccgctgcaggatggtcccgcgcctcagtttccctgtctggggtctattggagcatggtcctgcgcgggtcgcttcatagctggggagaagagcaggatggtctcaggggcgccagggttttcaagttttgagacggggtttcaccgtggtctcgatctcctgacctcgtgatccacccgccttggcctcccaaagtgctgggattacgggcatgagccaccgcacccggcctgtagtttttcatcttttaaagtctttgtaatcttcggaagcctttaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacact

SEQ ID NO: 118666 - DNA, 612 bp, Homo sapiens
  Payload ID: 3228
  Gene Symbol: C19orf44
  Gene Name: chromosome 19 open reading frame 44
  ENST ID: ENST00000601109
  CDS Start-End: 1-108
ggggcctgccctgggaggcgcctacgtggacccgacacccatcgccaatcatgttatcagtgcagatgcaatagaagtacattaggtgccacagacctgccccactgaccatggaggatgccctggaggaggtgaacaaggagctgtgagcgccagcaggtggagcttgacgtgacgtcttaacaaaagcaaagcaccgcagcttcccagagttaccagcgcagcacttaagacaggatcttacggcggggtggggctcctggaccgtgaccggcgtcttcttcctggggagtacgacttggaccgggaccgcgactgggaccgggagcggcttctggaggagcgcgacctgctccgacttctgcagggaagggtgcccaagggtcagcagcagccaggcgtcgtggggaggccacaggaagaggcctcaggcactgccctgaggcagcctctgcctacctagatctggagcgggagtaggaacgggagcaggagcgcgaccttgaccttgagtacgagcctgaagacttggaggatcttgagttggagcgggaggaagaacgccctcgactcttggatctgctccgagacctcgagggtccgctgtgggga

SEQ ID NO: 118667 - DNA, 1071 bp, Homo sapiens
  Payload ID: 3228
  Gene Symbol: C19orf44
  Gene Name: chromosome 19 open reading frame 44
  ENST ID: ENST00000596592
  CDS Start-End: 62-832
aaccgctccttcaggcgtgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttct

SEQ ID NO: 118668 - DNA, 439 bp, Homo sapiens
  Payload ID: 3228
  Gene Symbol: C19orf44
  Gene Name: chromosome 19 open reading frame 44
  ENST ID: ENST00000601288
  CDS Start-End: 1-280
acccatcgccaatcatgttatcagtgcagatgcaatagaagccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagctacaggaaatctagaacaaaatcaaatattcatcacgttgggttgaaaagttggaagattttgcatcttattgaaaagaatttttcaaaaatgtttctgtacaaatgaatggaattgc

SEQ ID NO: 118669 - DNA, 565 bp, Homo sapiens
  Payload ID: 3228
  Gene Symbol: C19orf44
  Gene Name: chromosome 19 open reading frame 44
  ENST ID: ENST00000594813
  CDS Start-End: 232-565
gaggtcggcagggctggtggggaggtgacctagctgggcgtccgggctcgcgagggggatacggggaaatggggccttctccggggctgagctggttgggccgctgcaggatggtcccgcgcctcagtttccctgtctggggtctattggagcatggtcctgcgcgggtcgcttcatagctggggagaagagcaggatggtctcaggggcgccagggttttcaagttttgaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagagga

SEQ ID NO: 118670 - DNA, 3248 bp, Homo sapiens
  Payload ID: 3228
  Gene Symbol: C19orf44
  Gene Name: chromosome 19 open reading frame 44
  Uniprot ID: Q9H6X5
  ENST ID: ENST00000593380
  CDS Start-End: 29-1885
ctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggtggccagcatggcagccatggggcctgccctgggaggcgcctacgtggacccgacacccatcgccaatcatgttatcagtgcagatgcaatagaagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagcaaagcaccgcagcttcccagagttaccagcgcagcacttaagacaggatcttacggcggggtggggctcctggaccgtgaccggcgtcttcttcctggggagtacgacttggaccgggaccgcgactgggaccgggagcggcttctggaggagcgcgacctgctccgacttctgcagggaagggtgcccaagggtcagcagcagccaggcgtcgtggggaggccacaggaagaggcctcaggcactgccctgaggcagcctctgcctacctagatctggagcgggagtaggaacgggagcaggagcgcgaccttgaccttgagtacgagcctgaagacttggaggatcttgagttggagcgggaggaagaacgccctcgactcttggatctgctccgagacctcgagggtccgctgtggggagaggcctgatgatcaggtgccccagtggatgggctgcacccagcccaccctggccctcaggttcctagaccaccccagatgcaggggctctggctgtggatgtggcgccatagccacagcaacggtaccaagttcctaaatagtgtggccgagcctgctgctgtgtgaattcaggccttgtggaaaacaccgccccataggcacaggctgtgtgagggtggacgtgatgagtgtatctggggtctgctcccacccatcacaagctgtggaccctggccccccggccactgcagacatctgcgcttttacctgttcctcttctcctggcctttcctccgccgggcccgcatttttgctcggaagaactcatagaggccgttctgctcccagccttcactgtaagacacggcattccgtgtgtgaccacgtgacacccacccacaaggaagtcgtgaaaaagtcatcaggagttaatccacagaaccttggagagtacatggccctgtggctgtgggctccgagcatgggcgcagtagagcttggttcagtgttcccacagggctgtcctcctgcagcccagtggctcctctggtgcccacgcccttgccaccctgctgttccgctgaggtggtggggacccatggtctgtggaactgggaaacaggaacactgactcatgggtggacaggcctgcagcccagcacaggaaggaggggtgaccactgggaagggtgggctgagggccctgtggcagccggctgcttgagacgtgccgccgtgccacaccttccctaacttcttctgatgtgtctccattaaaacgcccttcattgagg

SEQ ID NO: 118671 - DNA, 2609 bp, Homo sapiens
  Payload ID: 3228
  Gene Symbol: C19orf44
  Gene Name: chromosome 19 open reading frame 44
  ENST ID: ENST00000594035
  CDS Start-End: 74-1951
gttgcccagggcaaccgctccttcaggcgtgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagctacaggaaatctagaacaaaatcaaatattcatcacgttgggttgaaaagttggaagattttgcatcttattgaaaagaatttttcaaaaatgtttctgtacaaatgaatggaattgcaccaggctgcccatggacaccaggtgtggccgattcccaacggtcacccaccagcttctggcaggagcagctcccctcctggcctcccctcccttcgggggtgtgaaatgaaatgatggagtggaaggcgctggctggggtcgggctccatgctctggatgggactgggccgtcgcacacgccagccggtgcagggttcttccaagtgcaaaactcaagcaggggacgcgacgggcacagactccgaggcagcgctcaacctgaagtgtcttaggctggtttcctgttagaatcttgtttcccagataacagcaaatggctacattccagaaaaaaaatatcaacttatacaactaaaataactgaactaagggccagtacgccttcgaagaattaggtttcagaatctcactgggcctcctctcaggtcagtattcttctttctagacctaaaccaaggagagtaaaaatgaaaaccctgcttcacttcgcaagtcaa

SEQ ID NO: 118672 - DNA, 1679 bp, Homo sapiens
  Payload ID: 3229
  Gene Symbol: C19orf45
  Gene Name: chromosome 19 open reading frame 45
  Uniprot ID: Q8NA69
  ENST ID: ENST00000361664
  CDS Start-End: 142-1659
ggatgcagcctgggaaggaacatgaggatcctctgagagaccagggacagagggagacccaaagatctggtctgtagctaagtgaattttctaaaactcattgattcacacgccatcccttgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggcctcctccggagtggagctgggagactgcaagatcagctatggatcaacgtgttcggagcagaaacaggcctacaggccccaggatctgcctgaagataggtatgacaaggcccaggccacagcccacatccactgtgtaaatatccgtcctggtgacggcctcttccgcgacaggaccaccaaggccgagcacttctatgccagggagccagagccttttgttcttcaccacgatcagactccggagtcgcacatcctgaaaggaaattggtgccccggccccggcagtctggacaccttcatgcagtacttctacggccagccgccacccccgacccagccacccagccgccacgtgcctcatgagaaattgcagagtcatgtgaccctaggggagccaaagctactcaaacgcttcttcaagaccaccatgggctcggactactgcccttcagagtggagacaggtgcagaaagcgcccaacctccacttgcagcaaagctacctgccgcggggcacgggcgaattcgattttttaaccatgaaccagaagatgctgaagccacacagaacacctccggccccggtgactgaagagatgctacagcggtgcaagtacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccccctatgtacctgtgccccagccagcaataaatgccatcttggcaacattc

SEQ ID NO: 118673 - DNA, 833 bp, Homo sapiens
  Payload ID: 3229
  Gene Symbol: C19orf45
  Gene Name: chromosome 19 open reading frame 45
  ENST ID: ENST00000601176
  CDS Start-End: 257-833
ccctgagcctcaatgtcttttgtgaagcagtggttaaaacctacccttggccaggcatggtggctaacacctgtaatcccagcactttgggaggctgaggcagaagggttgcttgagcccaggagtttgagaccagcctgagcaacatagccagacccctgtctctaaaaaaaaaaatagaaagaattagccatgcatggtggtgcacacctatagtcccagatgctcagaagactgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcg

SEQ ID NO: 118674 - DNA, 786 bp, Homo sapiens
  Payload ID: 3229
  Gene Symbol: C19orf45
  Gene Name: chromosome 19 open reading frame 45
  ENST ID: ENST00000596132
  CDS Start-End: 117-786
acaccctcctggacacttcctacccatgttacctgctggtgacctgtcttgttcatggctatatccgcacagcctggcagaaaacagagaatctgttttgtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttga

SEQ ID NO: 118675 - DNA, 578 bp, Homo sapiens
  Payload ID: 3229
  Gene Symbol: C19orf45
  Gene Name: chromosome 19 open reading frame 45
  ENST ID: ENST00000597207
  CDS Start-End: 37-578
gagagctaactctcagaaggtggctggtgtcccgcgatggccacaggcgccctcctgccgtgctcgcgcccgtgcccgatgtcccggctggacttcctcaaggcctcgcacttctcgctggggcctgacctgcggctgcacgagggcaccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgc

SEQ ID NO: 118676 - DNA, 562 bp, Homo sapiens
  Payload ID: 3229
  Gene Symbol: C19orf45
  Gene Name: chromosome 19 open reading frame 45
  ENST ID: ENST00000596524
  CDS Start-End: 1-273
atcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggaccaccaaggccgagcacttctatgccagggagccaggtgagagcctgaggcccgccccgtcccgcctcccaccgcagcctcccagggcagctctgcacctgttccgcttctggcagagccttttgttcttcaccacgatcagactccggagtcgcacatcctgaaaggaaattggtgccccggccccggcagtctggacaccttcatgcagtacttctacggccagccgccacccccgacccagccacccagccgccacgtgcctcatgagaaattgcagagtcatgtgaccctaggggagccaaagctactcaaacgcttcttcaaga

SEQ ID NO: 118677 - DNA, 1774 bp, Homo sapiens
  Payload ID: 3230
  Gene Symbol: C19orf47
  Gene Name: chromosome 19 open reading frame 47
  ENST ID: ENST00000357884
  CDS Start-End: 1-439
agggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgatggagtctccctctgttgcccaggctggagtacagtggcgcgaccttggctcagtgcaacctccgcctcccgggttcaagcagttctcctgcctcagcctcccgagtagctgggattacagctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctg

SEQ ID NO: 118678 - DNA, 2126 bp, Homo sapiens
  Payload ID: 3230
  Gene Symbol: C19orf47
  Gene Name: chromosome 19 open reading frame 47
  Uniprot ID: Q8N9M1
  ENST ID: ENST00000392035
  CDS Start-End: 240-1307
gacagttggcgccgccgggagggagggcgggcggcgcgagtgggcgcgggcccggtgggccaggctccagggagcagtgtcagggccagggagacgatggtctccgtgactatgggtgagtctgtggccttctctccagggccccctctccccactgccctttttgagccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaa

SEQ ID NO: 118679 - DNA, 3628 bp, Homo sapiens
  Payload ID: 3230
  Gene Symbol: C19orf47
  Gene Name: chromosome 19 open reading frame 47
  Uniprot ID: Q8N9M1
  ENST ID: ENST00000582783
  CDS Start-End: 14-1282
gggcggtcacgtgatggttatggccgcactctcgctggtggcggcctgttggggtagagcggccgcggacgagtcagttcagcttccggcggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctgagccaggcctgtcctaggagctggtagcaggtagtgagcagggcctctccagggatggggtgtaggtaaagcggtggtgctggccaaggaatctgaggagtgggagaaagtggccagggccgcttcagtggttgtggataggaaggccttgcagaaggggtgacatggaggccaagttgggaatgtggcttcatgaagttcaggaggagagctttcagacagagggacagccaggggcagaggtgctgaggtgggacaaggaacaggaagaaggctggtggctgtgggtgagggtgggccctgcctccagcatgaggcagaggtgggtgggcaggggctaggtggctgggggtgttgtgatcaaggaggaggaatgtgcacagtgacccgggagtgctggatcgggaggatttggagctgggatgtgctgagctgagtttcatttaggatcatcgctctggcttctgtgaggagaaggaatggctgggagggctggggtggatgccactgcagcagtccaggcaggaagccaggatggctgcgagggcatggcagtggggagcagggaagagggccgcttgggctgcttagggtgtgctttggaggaagagctgtgggatgtgctgatgggttggaagttggggctagagaagatgagaatcatagggcccgcctagatgttagaccggagcatctgggggaacggctgttaacagagaaggggagacgggaggaaggtcaaggaagagggagctgtgttctgactgcattgcgcctgttagggtccccgctggggctcaggcggacacctgggctgggggttcatggctgctgacagtgcgcagggtacagctggaatcaaagccaagggccttggctgggcgtggtggcttacgcttgtaatcccagcagtttgggaggccaaggcgggtggatcacaaggtcaggagttcgagaccagcctggccaagatggtgaaaccccgtctctactaaaaatacaaaaattagccgggtgtggtgacaggtgcctgtaatcccggctacttaggaggctgaggcaggaggatcgcttgaacccgggaggtggaggttgcagtgagctgagatcgtgccactgcactccagcctaggcaacaagagcgagactccatctcaaaaaaaaaaaaaaaaaaa

SEQ ID NO: 118680 - DNA, 563 bp, Homo sapiens
  Payload ID: 3230
  Gene Symbol: C19orf47
  Gene Name: chromosome 19 open reading frame 47
  ENST ID: ENST00000580977
  CDS Start-End: 1-426
atggttatggccgcactctcgctggtggcggcctgttggggtagagcggccgcggacgagtcagttcagcttccggcggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcagggtctcactccatcgcccaggctggagtgcagtagcactatctcggctcactgcaacctctgcctcccaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacct

SEQ ID NO: 118681 - DNA, 581 bp, Homo sapiens
  Payload ID: 3230
  Gene Symbol: C19orf47
  Gene Name: chromosome 19 open reading frame 47
  ENST ID: ENST00000582006
  CDS Start-End: 155-581
acgtgatggttatggccgcactctcgctggtggcggcctgttggggtagagcggccgcggacgagtcagttcagcttccggcgccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggagggga

SEQ ID NO: 118682 - DNA, 803 bp, Homo sapiens
  Payload ID: 3230
  Gene Symbol: C19orf47
  Gene Name: chromosome 19 open reading frame 47
  ENST ID: ENST00000580606
  CDS Start-End: 365-803
aaaaaaaaaattgagcagaagccagagaagggcaagattaaccctagtgaggatagagaagagagtctcatatgtggggacttagggaaagtgtcacaaagtagatggcagtggagcagaaggaaggataggttgccaggaggagacaggcattccaggcacaggtgacatcctctaaaaactgggaggccggcaaagcacctgtgtggggaaggaggcctggaggatgagaccaggcacaacacctccagggtgcttagtaggcaccaagcactgtctcaagtgcttttattcatagaaactcatccagcccttatagcagtcctctaaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactg

SEQ ID NO: 118683 - DNA, 550 bp, Homo sapiens
  Payload ID: 3230
  Gene Symbol: C19orf47
  Gene Name: chromosome 19 open reading frame 47
  ENST ID: ENST00000577617
  CDS Start-End: 1-506
ctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggccagtgcctagagtgaagacagctgctgttttaatatatttttgtgactttcaaa

SEQ ID NO: 118684 - DNA, 1718 bp, Homo sapiens
  Payload ID: 3231
  Gene Symbol: C19orf48
  Gene Name: chromosome 19 open reading frame 48
  Uniprot ID: Q6RUI8
  ENST ID: ENST00000345523
  CDS Start-End: 974-1327
tcccagcggattctctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttta

SEQ ID NO: 118685 - DNA, 1666 bp, Homo sapiens
  Payload ID: 3231
  Gene Symbol: C19orf48
  Gene Name: chromosome 19 open reading frame 48
  Uniprot ID: Q6RUI8
  ENST ID: ENST00000391812
  CDS Start-End: 923-1276
tgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctgggagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttt

SEQ ID NO: 118686 - DNA, 782 bp, Homo sapiens
  Payload ID: 3231
  Gene Symbol: C19orf48
  Gene Name: chromosome 19 open reading frame 48
  ENST ID: ENST00000601267
  CDS Start-End: 708-782
gtttattactttttccggctgtgtggaaagacgcacgtgtcctgaagggttcgaggctgcgacgggagcggccatgtagtcgcgtggaaagggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggccc

SEQ ID NO: 118687 - DNA, 578 bp, Homo sapiens
  Payload ID: 3231
  Gene Symbol: C19orf48
  Gene Name: chromosome 19 open reading frame 48
  ENST ID: ENST00000593287
  CDS Start-End: 542-578
cgcttcggagagagaaatgctggggtgcagcttcaagcttaggaccacccaccatgcctatccaggtgctgaagggcctgaccatcactcattaagaacagaggaggctgcctgttactcctggtgttggtgagaaggcagatgtagacaggtgcccagcaagtgctgagccaggcgctgccctaagcactgggctcattaaccttagtaaccctgttggggggcggaggtgggatgggggctggggctgggttgcagtgagatgtccagtgtccagggttcttgaaagggctgcacttggggaccccgtgatgtccagcactgggctctgactgcccctgaggacacggtgcaccccgggacctttgacatccggggttctgaggggccccactccgggaggtgatggtgggggtgtggctgtttcccccattcgtgccttttctgtgtccttcccctgacagcatccctccagacactctgctgtttcctgcctaggcgtggctgcagccatggctaggaaagcgctgccaccaggctcatgctgggacccaacccagtgcacaaggacttggctg

SEQ ID NO: 118688 - DNA, 971 bp, Homo sapiens
  Payload ID: 3231
  Gene Symbol: C19orf48
  Gene Name: chromosome 19 open reading frame 48
  ENST ID: ENST00000597493
  CDS Start-End: 826-971
aatggcgcgtgctgcaacccgcgcccgcttcggagagagaaatgctgggagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccag

SEQ ID NO: 118689 - DNA, 1639 bp, Homo sapiens
  Payload ID: 3231
  Gene Symbol: C19orf48
  Gene Name: chromosome 19 open reading frame 48
  Uniprot ID: Q6RUI8
  ENST ID: ENST00000596655
  CDS Start-End: 952-1305
ggtgcagcttcaagcttaggaccacccaccatgcctatccaggtgctgaagggcctgaccatcactcattaagaacagaggaggctgcctgttactcctggtgttggtgagaaggcagatgtagacaggtgcccagcaagtgctgagccaggcgctgccctaagcactgggctcattaaccttagtaaccctgttggggggcggaggtgggatgggggctggggctgggttgcagtgagatgtccagtgtccagggttcttgaaagggctgcacttggggaccccgtgatgtccagcactgggctctgactgcccctgaggacacggtgcaccccgggacctttgacatccggggttctgaggggccccactccgggaggtgatggtgggggtgtggctgtttcccccattcgtgccttttctgtgtccttcccctgacagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcac

SEQ ID NO: 118690 - DNA, 1844 bp, Homo sapiens
  Payload ID: 3231
  Gene Symbol: C19orf48
  Gene Name: chromosome 19 open reading frame 48
  Uniprot ID: Q6RUI8
  ENST ID: ENST00000598463
  CDS Start-End: 1100-1453
ggtcctttaaggtcttgaacatcggtttcctgacttgagcggggcccatgcccctgccgaggaggctcagcctggaagcagctagcccatttcctatctcccccaccacgaccccagcaaggatctctacttgacttacctccttcaggcaaccacctagaaaatcgttgagtttgttcatgtcacaagtgaaagtattttttcatgcattcatcgttggcacgtcgtcctttggcaatattaaaatctaccaacaaatgggaaaagttaacatttgcaccatcttgccatattcaaaaaccttgtgcttaagtgttttgaaaagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagctttta

SEQ ID NO: 118691 - DNA, 709 bp, Homo sapiens
  Payload ID: 3231
  Gene Symbol: C19orf48
  Gene Name: chromosome 19 open reading frame 48
  ENST ID: ENST00000600373
  CDS Start-End: 596-709
tcaagcttaggaccacccaccatgcctatccaggtgctgaagggcctgaccatcactcattaagaacagaggaggctgcctgttactcctggtgttggtgagaaggcagatgtagacaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgc

SEQ ID NO: 118692 - DNA, 827 bp, Homo sapiens
  Payload ID: 3231
  Gene Symbol: C19orf48
  Gene Name: chromosome 19 open reading frame 48
  ENST ID: ENST00000596287
  CDS Start-End: 582-827
gtgcagcttcaagcttaggaccacccaccatgcctatccaggtgctgaagggcctgaccatcactcattaagaacagaggaggctgcctgttactcctggtgttggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtcc

SEQ ID NO: 118693 - DNA, 892 bp, Homo sapiens
  Payload ID: 3231
  Gene Symbol: C19orf48
  Gene Name: chromosome 19 open reading frame 48
  ENST ID: ENST00000597705
  CDS Start-End: 650-892
agcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctg

SEQ ID NO: 118694 - DNA, 1425 bp, Homo sapiens
  Payload ID: 3232
  Gene Symbol: C19orf52
  Gene Name: chromosome 19 open reading frame 52
  Uniprot ID: Q9BSF4
  ENST ID: ENST00000270502
  CDS Start-End: 91-873
gttggcgcttgcgcagaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctggggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctgcagccccgctggaccgacttccccggccgggtcctggacgtgggcttcgtgggtcgctggtgggtgctgggggcctggatgcgcgactgcgacatcaacgacgacgaattcctgcacctgccggcgcatttgcgggtggtcgggccccagcagctgcattccgagaccaacgagcggctcttcgatgagaagtacaagcctgtcgtgctcaccgacgatcaggtggaccaggcgctgtgggaggagcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagtgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaatgtttttattcta

SEQ ID NO: 118695 - DNA, 859 bp, Homo sapiens
  Payload ID: 3232
  Gene Symbol: C19orf52
  Gene Name: chromosome 19 open reading frame 52
  ENST ID: ENST00000588807
  CDS Start-End: 1-82
gcaggtcttgcagaaggagaagaaggacaggctcgccctgagccaggcccactcgctggtgcaggcggaggccccgagatgaaaccctgaggcccccgagtcctggcaaactgcttgcctggggtggtgcagttctgagtgtgcctcacctgcagaacagctgagacagatgatgtgcaaagtgttttctcactggatttgcacaagtttggggagcctttctgccccccgtctttgttctttattagctgaagctaattcagagccacctgggtccgggagttggggacagcagaacgacttgacacatgttcatcactggcagagctggtcatgagccttttatataagcctttttcatcgggcctcagaggccctccttaaggaggtaccacattggtcagctgacttgcaaactcttctaaggccacttagattttctttttcaagtttgggttgtggcctggcatggtgatgtctgtaatcccagcagtttgcaaactgaggcaagagaatcgcttgaggccaggagtttgaggccagctagagtgacatagcaagactccgatgctacaaaaaagaataataatagtaattaactaaataaaatttgagctgaaatgtttttattctatgacctattctctctcgttttttttttttttttttttgagacagggtcttgctctgttttgcctgctggagttgcagtgagccgagatcacgccactgcgttccagtctgggcaacagagtgagactccgtcacacaaaaaaaaaaaaagagaaaaaataaataacataaaactgaagtattaagggagtgatgctacctcaggggcctgtggcaagttaataaa

SEQ ID NO: 118696 - DNA, 504 bp, Homo sapiens
  Payload ID: 3233
  Gene Symbol: C19orf53
  Gene Name: chromosome 19 open reading frame 53
  ENST ID: ENST00000221576
  CDS Start-End: 1-243
tggcgcaggggcagcgcaagtttcaggcgcacaaacccgcaaagagtaagacggcagcggcagcctctgaaaagaatcggggcccaagaaaaggcgaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtca

SEQ ID NO: 118697 - DNA, 499 bp, Homo sapiens
  Payload ID: 3233
  Gene Symbol: C19orf53
  Gene Name: chromosome 19 open reading frame 53
  ENST ID: ENST00000588841
  CDS Start-End: 1-18
cccaagaaaaggcggtaaggagcggcccggggacttgggggcgaggtggacccccggcttcccggcctcacgtgagcacatctttccccaggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccc

SEQ ID NO: 118698 - DNA, 357 bp, Homo sapiens
  Payload ID: 3233
  Gene Symbol: C19orf53
  Gene Name: chromosome 19 open reading frame 53
  ENST ID: ENST00000592760
  CDS Start-End: 1-94
aaaaggcggtcgtgttatcgctcccaagaaggcgcgcgtcgtgcagcagcaaaagctcaagaaggtttcactatgctgctcgggctggtcttgaactcctggcctcaaggcatcctcccgcctctgcctcccaaaatgctgggattacaggcgtgagccaccctatggttgtttttaagtgcaacatttatatgtagatggaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctgg

SEQ ID NO: 118699 - DNA, 873 bp, Homo sapiens
  Payload ID: 3233
  Gene Symbol: C19orf53
  Gene Name: chromosome 19 open reading frame 53
  Uniprot ID: Q9UNZ5
  ENST ID: ENST00000588234
  CDS Start-End: 311-610
cagaggtgagtgccacaccctaacctagtctgagtttttatgtgtaaagatcataaaacgttgtaagttttctaaaacacataagctctcaataaacgttagcttatcattgtcaccgttttgttcgtaatgtttgaaaactccaactgtgatccactacactacccttgtgggatgctgtctctttaactctgtgccacgttgtatcccgtgagttcttgcgtttttccgccccgctgtatcccatggttccctgtgccttccggctacgactgctcacagtcccgcctcttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatc

SEQ ID NO: 118700 - DNA, 666 bp, Homo sapiens
  Payload ID: 3233
  Gene Symbol: C19orf53
  Gene Name: chromosome 19 open reading frame 53
  ENST ID: ENST00000588858
  CDS Start-End: 1-149
caaagagtaagacggcagcggcagcctctgaaaagaatcggggcccaagaaaaggcggtcgtgttatcgctcccaagaaggcgcgcgtcgtgcagcagcaaaagctcaagaagagacaggtttcactatgctgctcgggctggtcttgaactcctggcctcaaggcatcctcccgcctctgcctcccaaaatgctgggattacaggcgtgagccaccctatggttgtttttaagtgcaacatttatatgtagatggaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatc

SEQ ID NO: 118701 - DNA, 491 bp, Homo sapiens
  Payload ID: 3233
  Gene Symbol: C19orf53
  Gene Name: chromosome 19 open reading frame 53
  ENST ID: ENST00000593274
  CDS Start-End: 57-227
ctggggacgagctaggagcgaggggatagagccaggggccgcgttaggagcgaaggatggagcccggggcgcagagagggaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatcc

SEQ ID NO: 118702 - DNA, 2753 bp, Homo sapiens
  Payload ID: 3234
  Gene Symbol: C19orf54
  Gene Name: chromosome 19 open reading frame 54
  Uniprot ID: Q5BKX5
  ENST ID: ENST00000378313
  CDS Start-End: 121-1176
cccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagtggccgatatgggcaggctggcccaggaggtgctgggctgccaggccaagctgctctctggtggcctgggcggtcccaacagagacctcgtcctgcagcacctggtcactggacatcccctgctcatcccctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcggtaaccatttgaagtgtgcctacacttctcccactgtgtgatggcgacaagattgaagctaggtctcaggggtctccagtcctccttcatcagggccaccccctgcagtattgagcaccagctggtccctctagggagagattgacaacagcccggaccctgcggcctgcctattccatctgaatgtcgcatcgtctgtttctcactaggggccgcctctgtcatctcactagacatttgaggaacctcctgcctgggccctctgcttctcacaggacagggacactgaactgcgtcagcctcagctcacccctccttagcccaaggtcttcctcatgcttgccacctactagtcatactggccttttagatccctgaagtgttgttcaaatccccggatcattgagtcccacccccagccctctgctgcggatcactccttaacttttccattggggctcaggtatcactacctcagggaagagtcctgcagccccagtcaagacacccctcccccacctcatgtcttcacagttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaaggtcaggattcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttttttagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacattggc

SEQ ID NO: 118703 - DNA, 553 bp, Homo sapiens
  Payload ID: 3234
  Gene Symbol: C19orf54
  Gene Name: chromosome 19 open reading frame 54
  ENST ID: ENST00000598485
  CDS Start-End: 215-418
ttgacctctgactcaaagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgac

SEQ ID NO: 118704 - DNA, 1104 bp, Homo sapiens
  Payload ID: 3234
  Gene Symbol: C19orf54
  Gene Name: chromosome 19 open reading frame 54
  ENST ID: ENST00000596809
  CDS Start-End: 380-553
cgggtgcaggggacggaagaggggccagcccgtgcgggacagtctggactccggactatcccgagaactcaccatccttcttgatcttctcattgaggttgttgatataaatagtgtggttagggcgggtctcgggaactgccatggagtgaagtgttgagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcgttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaaggt

SEQ ID NO: 118705 - DNA, 2521 bp, Homo sapiens
  Payload ID: 3234
  Gene Symbol: C19orf54
  Gene Name: chromosome 19 open reading frame 54
  ENST ID: ENST00000470681
  CDS Start-End: 427-600
ccgccattttccgggagtgggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcggtaaccatttgaagtgtgcctacacttctcccactgtgtgatggcgacaagattgaagctaggtctcaggggtctccagtcctccttcatcagggccaccccctgcagtattgagcaccagctggtccctctagggagagattgacaacagcccggaccctgcggcctgcctattccatctgaatgtcgcatcgtctgtttctcactaggggccgcctctgtcatctcactagacatttgaggaacctcctgcctgggccctctgcttctcacaggacagggacactgaactgcgtcagcctcagctcacccctccttagcccaaggtcttcctcatgcttgccacctactagtcatactggccttttagatccctgaagtgttgttcaaatccccggatcattgagtcccacccccagccctctgctgcggatcactccttaacttttccattggggctcaggtatcactacctcagggaagagtcctgcagccccagtcaagacacccctcccccacctcatgtcttcacagttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaaggtcaggattcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttttttagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacattggc

SEQ ID NO: 118706 - DNA, 1792 bp, Homo sapiens
  Payload ID: 3234
  Gene Symbol: C19orf54
  Gene Name: chromosome 19 open reading frame 54
  ENST ID: ENST00000469741
  CDS Start-End: 488-1000
aaaatgggcgggaactgttgcgtgtaataccacgtgatatgggaaaggcagtgtgcgggggccgccattttccgggagtgggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagtggccgatatgggcaggctggcccaggaggtgctgggctgccaggccaagctgctctctggtggcctgggcggtcccaacagagacctcgtcctgcagcacctggtcactggacatcccctgctcatcccctacgacgaggacttcaaccatgagccgtgtcagaggaagggccacaaggcacactgggcggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacattggc

SEQ ID NO: 118707 - DNA, 947 bp, Homo sapiens
  Payload ID: 3234
  Gene Symbol: C19orf54
  Gene Name: chromosome 19 open reading frame 54
  ENST ID: ENST00000597507
  CDS Start-End: 383-556
ctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggggccgcctctgtcatctcactagacatttgaggaacctcctgcctgggccctctgcttctcacaggacagggacactgaactgcgtcagcctcagctcacccctccttagcccaagttttaaagcccatctgggagcagttacctgtgccagcccctctacctgtgttagcagatctggcaaccctgtaa

SEQ ID NO: 118708 - DNA, 492 bp, Homo sapiens
  Payload ID: 3234
  Gene Symbol: C19orf54
  Gene Name: chromosome 19 open reading frame 54
  ENST ID: ENST00000596940
  CDS Start-End: 1-338
cctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgaca

SEQ ID NO: 118709 - DNA, 369 bp, Homo sapiens
  Payload ID: 3234
  Gene Symbol: C19orf54
  Gene Name: chromosome 19 open reading frame 54
  ENST ID: ENST00000600139
  CDS Start-End: 1-196
tcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcagtatgtgccctgatgcgggaaccccagcccatctgctgcctttactctgcccttgctgggcttcttaaggactgatctggagaagaggagtggattgtccctgctgggaggaggagggaaggaaagggggaactttccactcaggcttctgagtgcctgcatagtaaacatagttgggacatgcga

SEQ ID NO: 118710 - DNA, 546 bp, Homo sapiens
  Payload ID: 3234
  Gene Symbol: C19orf54
  Gene Name: chromosome 19 open reading frame 54
  ENST ID: ENST00000598352
  CDS Start-End: 1-546
cctgctccccgtcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggggccgcctctgtcatctcactagacatttgaggaacctcctgcctgggccctctgcttctcacaggacagggacactgaactgcgtcagcctcagctcacccctccttagcccaagttttaaagcccatctgggagcagttacctgtgccagcccctct

SEQ ID NO: 118711 - DNA, 2489 bp, Homo sapiens
  Payload ID: 3235
  Gene Symbol: C19orf57
  Gene Name: chromosome 19 open reading frame 57
  Uniprot ID: Q0VDD7
  ENST ID: ENST00000346736
  CDS Start-End: 129-2042
ctggctggggcggtgctgactgtcgcgggctgcgagggcggtgtttgcgtcgctcatgcgcggggcgggacctcgcggggcgcgggaaagaggcagagcgcgcgcagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgagccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtagaggc

SEQ ID NO: 118712 - DNA, 1049 bp, Homo sapiens
  Payload ID: 3235
  Gene Symbol: C19orf57
  Gene Name: chromosome 19 open reading frame 57
  ENST ID: ENST00000589393
  CDS Start-End: 1-886
ccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggccaccagtgagccgtcctccagcctgctgtgtgtgaggagggcaccctctcccccgcaccatgcccggggtctccgcagcctgtcccctcctcccgtgccctcccacagccctcctcgaagccagcgctgggtggctgccctctctgttacctggcacttgaacctgcctctctgcagaggcggcagcttatcaattat

SEQ ID NO: 118713 - DNA, 2454 bp, Homo sapiens
  Payload ID: 3235
  Gene Symbol: C19orf57
  Gene Name: chromosome 19 open reading frame 57
  Uniprot ID: Q0VDD7
  ENST ID: ENST00000586783
  CDS Start-End: 1-2007
atgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctggaaacaatcgcagagtccagcgcccagagtccaggatgccagctgctagtggagaccctgggggtccccctccaggaggccacggagctgggggacccaacgcaggcagacagtgcccgccctgagcagagcagccagagccctgtgcaggcggtgcccggcagtggggattctcagcctgatgaccctccagacagggggacggggttgtccgcctcacagagggccagccaagaccacctgtcagaacaaggggccgatgacagcaagcctgagacagacagggttccaggtgacggtggccaaaaggaacacctaccaagcattgattctgaaggggagaagccagacagaggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtagaggc

SEQ ID NO: 118714 - DNA, 360 bp, Homo sapiens
  Payload ID: 3235
  Gene Symbol: C19orf57
  Gene Name: chromosome 19 open reading frame 57
  ENST ID: ENST00000585755
  CDS Start-End: 286-360
ctcttgtgcatcttcaaggctggatgcccggaccacctgcccccaagcccggccttgccctgcctccttccccgggctctgtcgccgcgcactcgcccttcctgagtcctgcactcctcgtcggcgccccgcggccgtcgatcccgagccctcgcttccctgcttggccgtcccacttccgcctcgggcctcgggcgccgccgcaccggagcgcggccactgggctcgccgggtctgccgagccgaaactacaactcccggcagatttctcaaggggaagataaaatgactaagaggaagaagctgcggacctcagctcccctgatgaggaaacaggatctccctgccggctcctccgtc

SEQ ID NO: 118715 - DNA, 1559 bp, Homo sapiens
  Payload ID: 3235
  Gene Symbol: C19orf57
  Gene Name: chromosome 19 open reading frame 57
  ENST ID: ENST00000591586
  CDS Start-End: 415-1146
cgcggggcgggacctcgcggggcgcgggaaagaggcagagcgcgcgcaggtgtgaggggcggcgacatctgtggggttcagagcgtctgtcagtcaccgacgggctccggcttcacgtgggctctcggcctgtggagtcctcacttctcggtggtcggcgtagtgtcagtgtggggcttgtcaccgggagcggggtctacagcgcccaccctcaggcctttccatctttcacctccggactcgaggcctccagcgttctgtgagggccaatttggccatttattttttccaaaaagagtaacgcggataattcaagcgacttattcccaactgatccaggcagagctcgtttctgataaggacagagggtcctcaacgacttctgtggcccagatttctcaaggggaagataaaatgactaagaggaagaagctgcggacctcaggagagggactctgtcctccaaaacccctaaagaacccaaggctaggagacttctatggggacccccagagttccatgttgggctgtttacatcaccctgaggagccagagggcaaattgggacctgttccctctacacagcagcacggggaggaaccaggaaaggccgtctccagctcccctgatgaggaaacaggatctccctgccggctcctccgtcaaccagaaaaggagccagctccccttcctccttcccagaactcattcgggaggtttgttccccagtttgcaaaatccaggaagacagtgacaagaaaagaagagatgaaggatgaggaccgtgggagtggggcctttagcctgctctttccttcggggaacaagccgggcccttgctggccgggccccagctcacatgccaatggagaccctgttgcagtggccaaggcccagccgaggaccttcgtggggatccaggcctctgaggcctccaggatggaggatgccaccaacgtcgtgcgtggcctcatcgttgagctctccaacctgaaccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttc

SEQ ID NO: 118716 - DNA, 718 bp, Homo sapiens
  Payload ID: 3235
  Gene Symbol: C19orf57
  Gene Name: chromosome 19 open reading frame 57
  ENST ID: ENST00000588115
  CDS Start-End: 1-264
ttcgtgcgcctgctagagctctttccttcggggaacaagccgggcccttgctggccgggccccagctcacatgccaatggagaccctgttgcagtggccaaggcccagccgagccggctgatcatgggcacccaccgggacctggaagctttcaagcgccttaactaccggaagacaaagctgggaggcaaagcccccctgccttacccttccaaggggcctgggaatatccctcgaggggacccaccctggagggagttgtaggccactttgaggtctgtgtttcctttgccacccagcccccatgtccgcagacctcctccaagatgctccagggggtcctagtggaccctacaaacctcccttcagttgcccggaagttggtcttccatggacaacacaaaggaggccgtgaggtcctggcctcacctggccagggtcaaggtcatttgccacccttggcttcagggagggaaactgtgtctcccacagccccagtgacttcaagcgggcctgggctccaggaagctggccacctctgagcagggcccatcctgtccggatttgcaaattttagggtcctgagccaagtatggatggttcagaatttgtttctttcctggaggagaagagagctccctttgttttctttctccccatttccattttatttcttctgggaagacccataataaatgattctgtagaggccccgtga

SEQ ID NO: 118717 - DNA, 569 bp, Homo sapiens
  Payload ID: 3235
  Gene Symbol: C19orf57
  Gene Name: chromosome 19 open reading frame 57
  ENST ID: ENST00000591439
  CDS Start-End: 1-420
cgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcagctctttccttcggggaacaagccgggcccttgctggccgggccccagctcacatgccaatggagaccctgttgcagtggccaaggcccagccgagagggcggctctgtccctgcctcctgccgtcactccctgtgacttgtacctgctgtgccactggccacctcccttagccacacacacaacctgcacgtggaccagaggcagttcatcagagcggcccgctgtggtttgagtgaagagccgggagggttcacatctgaatctccgacagcgtcccagggccaatgcagctcccctccccaccgtcctggatgtctgg

SEQ ID NO: 118718 - DNA, 839 bp, Homo sapiens
  Payload ID: 3236
  Gene Symbol: C19orf60
  Gene Name: chromosome 19 open reading frame 60
  Uniprot ID: Q96EN9
  ENST ID: ENST00000358607
  CDS Start-End: 78-683
gtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 118719 - DNA, 702 bp, Homo sapiens
  Payload ID: 3236
  Gene Symbol: C19orf60
  Gene Name: chromosome 19 open reading frame 60
  Uniprot ID: Q96EN9
  ENST ID: ENST00000450195
  CDS Start-End: 7-546
gcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggaaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 118720 - DNA, 410 bp, Homo sapiens
  Payload ID: 3236
  Gene Symbol: C19orf60
  Gene Name: chromosome 19 open reading frame 60
  ENST ID: ENST00000595490
  CDS Start-End: 1-181
gctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaattcccatccgctcttgtagggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 118721 - DNA, 491 bp, Homo sapiens
  Payload ID: 3236
  Gene Symbol: C19orf60
  Gene Name: chromosome 19 open reading frame 60
  ENST ID: ENST00000601736
  CDS Start-End: 1-201
atgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgt

SEQ ID NO: 118722 - DNA, 2117 bp, Homo sapiens
  Payload ID: 3237
  Gene Symbol: C19orf66
  Gene Name: chromosome 19 open reading frame 66
  Uniprot ID: Q9NUL5
  ENST ID: ENST00000253110
  CDS Start-End: 299-1174
gactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttata

SEQ ID NO: 118723 - DNA, 2140 bp, Homo sapiens
  Payload ID: 3237
  Gene Symbol: C19orf66
  Gene Name: chromosome 19 open reading frame 66
  Uniprot ID: Q9NUL5
  ENST ID: ENST00000397881
  CDS Start-End: 478-1200
agaacggtgcctagagatgggggagggatgatcccgtttccccttcccccaccggaacccccctgtctccatcccagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccagacaaagaaactgaggccgaagtcacttgccagcaagcaggggcagctgcgatttgaaccctggccacctggagtcagagcctgggctctaacatgcctgtcagtgggaacccagggggcagggagtggcttgcccaagtccccacagctggaagtgatacagctgggatttgaacccacatctctctcccacttagccgagcacaacgtggcctcaaaggggcgatatgtcacaacatcaacaagcatgtggcatttgcaggcaggaagatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatcctt

SEQ ID NO: 118724 - DNA, 550 bp, Homo sapiens
  Payload ID: 3237
  Gene Symbol: C19orf66
  Gene Name: chromosome 19 open reading frame 66
  ENST ID: ENST00000586889
  CDS Start-End: 1-233
tcgtgtacggggtaaagcaaaaagatggccaagaactaagtaacgatctggatgcccagacaaagaaactgaggccgaagtcacttgccagcaagcaggggcagctgcgatttgaaccctggccacctggagtcagagcctgggctctaacatgcctccgagcacaacgtggcctcaaaggggcgatatgtcacaacatcaacaagcatgtggcatttgcaggcaggaagtgagtatgggggtcaggctagcctcactcaggcaagccctcccctaagcctcagtttccccatctgagcaataaggtaacaggtgtgcccacctctcagggctgctatgaggacaactgaggccacacacctggctctcaataagtgagtggtgctctgtgagcttctggcgagttaggggcaccctactcattgcggccgggggcctcccccagcaaacgggtggaaagaggcctgagccccatccccagtttctgcccctgctatctccacccaggatccaccagaagatatgaagcaggaccgggacattcaggcag

SEQ ID NO: 118725 - DNA, 621 bp, Homo sapiens
  Payload ID: 3237
  Gene Symbol: C19orf66
  Gene Name: chromosome 19 open reading frame 66
  ENST ID: ENST00000590378
  CDS Start-End: 409-621
gtaaagggatgaaaggcggggggggggcggcggaggccaaaaccaagggtcaagttcgggccgggagaacggtgcctagagatgggggagggatgatcccgtttccccttcccccaccggaacccccctgtctccatcccagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccagacaaagaaactgaggccgaagtcacttgccagcaagcaggggcagctgcgatttgaaccctggccacctggagtcagagcctgggctctaacatgcctccgagcacaacgtggcctcaaaggggcgatatgtcacaacatcaacaagcatgtggcatttgcaggcaggaagatccaccagaagatatgaagcaggaccgggacattcaggcagtggcgacctccctcctgccactgacagaagccaacctacgcatgtttcaacgtgcccaggacgaccttatccctgctgtggaccggcagttt

SEQ ID NO: 118726 - DNA, 808 bp, Homo sapiens
  Payload ID: 3237
  Gene Symbol: C19orf66
  Gene Name: chromosome 19 open reading frame 66
  ENST ID: ENST00000587710
  CDS Start-End: 81-464
ggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccagacaaagaaactgaggccgaagtcacttgccagcaagcaggggcagctgcgatttgaaccctggccacctggagtcagagcctgggctctaacatgcctccgagcacaacgtggcctcaaaggggcgatatgtcacaacatcaacaagcatgtggcatttgcaggcaggaagatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatc

SEQ ID NO: 118727 - DNA, 565 bp, Homo sapiens
  Payload ID: 3237
  Gene Symbol: C19orf66
  Gene Name: chromosome 19 open reading frame 66
  ENST ID: ENST00000593131
  CDS Start-End: 1-432
gatccaccagaagatatgaagcaggaccgggacattcagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccgcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaa

SEQ ID NO: 118728 - DNA, 1481 bp, Homo sapiens
  Payload ID: 3237
  Gene Symbol: C19orf66
  Gene Name: chromosome 19 open reading frame 66
  Uniprot ID: Q9NUL5
  ENST ID: ENST00000591813
  CDS Start-End: 89-856
cggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccgcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaa

SEQ ID NO: 118729 - DNA, 751 bp, Homo sapiens
  Payload ID: 3238
  Gene Symbol: C19orf67
  Gene Name: chromosome 19 open reading frame 67
  ENST ID: ENST00000343945
  CDS Start-End: 104-751
aaattcaaaagaggcgaacggcccccggcgcggcggcgcggctccggtggagaggtcaaggcagggcagagaccaagtacagaaggagcagctggccaaggccatgcccaccttcttacagatgtgtgagccctacttcctgtacctggaggcagccgcgagaagcataccccccatctatggacccctgcaggagctggtccgaaaggggctgttagagatctcccaacagctgaccctgcgcctggaacagctggtcctcatgtacgcttcctttgggttcgtggacctggaggagatgaacccccttagcatctcctgtttcttttgcgggaggttctccatcagcctgtcccatgaggtctccatcttcagatactgtgccccaaccgcctacactgccagccgcttcccccgctacctctataagaagatgcgctggcacctggaagccaccccagaggcccctggtcggggacaagattcccttgtggattactactttctgtgctatcgagatacttgggaagacacaggccagagtccagccaattcgtgcccacagatccagaagctgtggtccatcggccgatgggtgcccctaggaccagccgaggatgacctttattcatggattttgtgcccgcagccgcttggggactaccagcagctgctgaccatcggcttcgaggagcccacgcccacgctggccaccgacctgctggtgcagatcctcacgggccaggcaggc

SEQ ID NO: 118730 - DNA, 1427 bp, Homo sapiens
  Payload ID: 3238
  Gene Symbol: C19orf67
  Gene Name: chromosome 19 open reading frame 67
  Uniprot ID: A6NJJ6
  ENST ID: ENST00000548523
  CDS Start-End: 136-1212
gcgcggcggcgcggctccggtggagaggtcaaggcaggggccagtcggaggctcccggggcggggtcgaacccgcggccaacctgagcagcagcggaagcttaaagagctcaggttcccgccccccggccctaccatggctacagagcagtggttcgaggggtcgctccccctggaccctggagaaacaccgcctccagacgccttggaacctgggacgccgccctgcggagacccctccaggtcgacgccccctggcaggcctgggaacccatctgagccggatcctgaagatgccgaggggcggctggctgaggcccgggcctccacgtcttcccccaaacctctggtcccccggcctgggccagcacctccccgcctatccctggacactttgttcagccccatcacccaacagctgcgctacctactgaagaaggcagatgatttccagagctacttgctctacagcagagaccaagtacagaaggagcagctggccaaggccatgcccaccttcttacagatgtgtgagccctacttcctgtacctggaggcagccgcgagaagcataccccccatctatggacccctgcaggagctggtccgaaaggggctgttagagatctcccaacagctgaccctgcgcctggaacagctggtcctcatgtacgcttcctttgggttcgtggacctggaggagatgaacccccttagcatctcctgtttcttttgcgggaggttctccatcagcctgtcccatgaggtctccatcttcagatactgtgccccaaccgcctacactgccagccgcttcccccgctacctctataagaagatgcgctggcacctggaagccaccccagaggcccctggtcggggacaagattcccttgtggattactactttctgtgctatcgagatacttgggaagacacaggccagagtccagccaattcgtgcccacagatccagaagctgtggtccatcggccgatgggtgcccctaggaccagccgaggatgacctttattcatggattttgtgcccgcagccgcttggggactaccagcagctgctgaccatcggcttcgaggagcccacgcccacgctggccaccgacctgctggtgcagatcctcacgggccaggcaggccaggcccggcctccgagcgcagccgggcctgcggggtgggcagcgcaggggtcttgaacctggggaagagggtaggagctggaacttgacagttccaaactccagaatagggggcaggggaggggctcactcgttctcgcagtgcagcccggcctcgccttccaaagggccaggccgagctgacctgtctgcaccgagtccggcttggccgtggggccctgaatgcggacacgtcagttttgtgttaaataaaagaaagaaagaggtcacag

SEQ ID NO: 118731 - DNA, 2277 bp, Homo sapiens
  Payload ID: 3239
  Gene Symbol: C19orf68
  Gene Name: chromosome 19 open reading frame 68
  Uniprot ID: Q86XI8
  ENST ID: ENST00000328759
  CDS Start-End: 33-1916
ggacgccgctccggggcgggtaggcccccaggatggagcggccggagcccccacccggcacggctgcggggcaggaggagcaggagctgcgggagcgggccttcttctcgtgggccgagttcagccgcttcttcgacgcgtggtgccagcagcggctggcgctcttcttcgtcaagagctccatgcacctggcgcgctgccgctgggccagtgcgcccccgctctacacgctcatcgacgtgctcaagtacagctacgtgcggcttgtgtgcaaggacgtgcgtgcgcccagccggcccgccgtggggcctccccagcccggctgccccgccttcatcatcgtcaagctgagcccgctgcgggaccgcctcgtggtgacggagtgccagctgacccactcacacccggcctgcccgctggagttcgcctactacttccgcccgggccacctgctggccaacgcctgcctgccggtgcgcaccaccaacaagatctccaagcagttcgtggccccagccgacgtgcgccgcctgctgtcctactgcaagggccgcgaccacggcgtcctggacgccctgcacgtgctcgagggcctcttccgcaccgaccccgaggccaaggtgaagctggtgttcgtggaggaccaggctgtggtggagacggtgttcttcctgacgtcgcgcaccagggcgctgctgcggcgcttccctcgcatgctgctggtggaccggctgccggggctgcagggcgcgctggatctgctggccgtgctgtgcgtggacggctcgggccgtgcgcgccaggctgcctgctgcgtggcgcgcccgggcacaccgagcctgctgcgcttcgcgctcgcgtcgctgctgcagagcgcgccagacgtcaagggccgcgtgcgctgcctcaccgccgggcccgaggtggcggcgcagttgcctgcagtgcgccagctgctgccctgcgcgcgcgtgcagatctgccgcgcgcagggcctggagacgctcttcagcaaggcgcaggagctgggcggcgccggccgcgaggacccgggcctgtggtcgcgcctgtgccgcctggctggcgcgtcgtcgcccgcagcctacgacgaggcgctggccgagctccacgcccacggcccagccgccttcgtggactacttcgagcgcaactgggagccccgccgcgacatgtgggtccgcttccgcgccttcgaggcggccagagacctggacgcgtgtgccctggtgcgaggccaccgccggcgactgctgcgtcgtctcagcccctcgcgtggcgtggcgcagtgccttcgcgacctggtggccatgcagtgggccgacgcggccggggaggcggtgcccgaggggcccgatggcggggggccttggctggaggatgagccagggaggggagcccagggggagaacgagagggtgaggggcctggagacaggcgactggggaggggctccgaaagaaggaagtatttggaggggagcccagatggagaaggagtgggcaagggcactggaaaccagagactggggcggggctcagttcgaaggtgagaaggggagggcactgcagatcagagattggagagggggtcggttggagaatcagaagccgaggggactggaagggggtgtcttgagagggtcgaagttagagaaagggcacctgagagggccagagattagagactggagggggccccagttggagggtgagaaagattggggactggaaggttatgtctggagggggtcccagttggaggaccaggcgctaagaggattggaagggtatacctggagggtggcccagctggaagatcgcaggagtaccaccgacctgagggggacccagtttgactatgagaggggaaagggagaaagtacagaagacagatgaaggagaggaggtaagcgagaaaaaatggaaaggggagccggaaatggaggagagaggacaagcaaagagacagaaatgaagacatgaggaaaagctgggggaagcaggagaggaagggacgggatgtaggagggggaagaaaaatcggagatgagacaaaagaaatgtgtgggagacgggtagagacgaaatgcaaggggcgtggttttggtttttctccaagacctggagacatcgacccccatcgccttctgaagagagagggagggcgggcactgggggtcaggagagtctccagcaggggaggggaattgtttggactattgttcttcaggattggaataaaacaatcttattttgg

SEQ ID NO: 118732 - DNA, 3588 bp, Homo sapiens
  Payload ID: 3239
  Gene Symbol: C19orf68
  Gene Name: chromosome 19 open reading frame 68
  ENST ID: ENST00000614654
  CDS Start-End: 33-2795
ggacgccgctccggggcgggtaggcccccaggatggagcggccggagcccccacccggcacggctgcggggcaggaggagcaggagctgcgggagcgggccttcttctcgtgggccgagttcagccgcttcttcgacgcgtggtgccagcagcggctggcgctcttcttcgtcaagagctccatgcacctggcgcgctgccgctgggccagtgcgcccccgctctacacgctcatcgacgtgctcaagtacagctacgtgcggcttgtgtgcaaggacgtgcgtgcgcccagccggcccgccgtggggcctccccagcccggctgccccgccttcatcatcgtcaagctgagcccgctgcgggaccgcctcgtggtgacggagtgccagctgacccactcacacccggcctgcccgctggagttcgcctactacttccgcccgggccacctgctggccaacgcctgcctgccggtgcgcaccaccaacaagatctccaagcagttcgtggccccagccgacgtgcgccgcctgctgtcctactgcaagggccgcgaccacggcgtcctggacgccctgcacgtgctcgagggcctcttccgcaccgaccccgaggccaaggtgaagctggtgttcgtggaggaccaggctgtggtggagacggtgttcttcctgacgtcgcgcaccagggcgctgctgcggcgcttccctcgcatgctgctggtggaccggctgccggggctgcagggcgcgctggatctgctggccgtgctgtgcgtggacggctcgggccgtgcgcgccaggctgcctgctgcgtggcgcgcccgggcacaccgagcctgctgcgcttcgcgctcgcgtcgctgctgcagagcgcgccagacgtcaagggccgcgtgcgctgcctcaccgccgggcccgaggtggcggcgcagttgcctgcagtgcgccagctgctgccctgcgcgcgcgtgcagatctgccgcgcgcagggcctggagacgctcttcagcaaggcgcaggagctgggcggcgccggccgcgaggacccgggcctgtggtcgcgcctgtgccgcctggctggcgcgtcgtcgcccgcagcctacgacgaggcgctggccgagctccacgcccacggcccagccgccttcgtggactacttcgagcgcaactgggagccccgccgcgacatgtgggtccgcttccgcgccttcgaggcggccagagacctggacgcgtgtgccctggtgcgaggccaccgccggcgactgctgcgtcgtctcagcccctcgcgtggcgtggcgcagtgccttcgcgacctggtggccatgcagtgggccgacgcggccggggaggcggtgcccgaggggcccgatggcggggggccttggctggaggatgagccagggaggggagcccagggggagaacgagagggtgaggggcctggagacaggcgactggggaggggctccgaaagaaggaagtatttggaggggagcccagatggagaaggagtgggcaagggcactggaaaccagagactggggcggggctcagttcgaaggtgagaaggggagggcactgcagatcagagattggagagggggtcggttggagaatcagaagccgaggggactggaagggggtgtcttgagagggtcgaagttagagaaagggcacctgagagggccagagattagagactggagggggccccagttggagggtgagaaagattggggactggaaggttatgtctggagggggtcccagttggaggaccaggcgctaagaggattggaagggtatacctggagggtggcccagctggaagatcgcaggagtaccaccgacctgagggggacccagtttgactatgagagggtcaggagtcttgaaggaagcccctggaggggggcgcagctgcacgatgaaagggcagggggactgagaactgcagaatggaaggggccacagtcagaagtagagaaggggagggggctggaggtcagaaacttgagggggatccccttggagaagtccctggagttggcccctgagaacggagaccaaaggggaccccagtgggaagatgagaggaggagagggccagagattgcagaggagaggggagcgagggtgggggtcaaaagaagaaggggcctggaggatatagttctggtccagctgggagacacgagggtcacaggcatggagaatggagatggagggggagcccggtccgtgggccccaagagccgagccggacgagggatggagtggggagacgcaggagggcggtgtctagggctggggaatggagtcgtgtctggcaccccggtggggactgtattggaaggcagcccagaatgggcagcggcgaggagtgaacacctggctgcaggtgacggcctgcaggaaggaggcgaagatggccccagggaaccaaagaggctttgccgacccccgggagaggaggaggtggactgggaacccctggccaaattccgagcagcctgcgggccagagctggcagacctggtggctgaggagttggcctttgctaggcagcatgggacccggggtttccactggaccggagctggctttgcccttaaggacggcacctcggacttcttcctggatggggccctgacacgctgcagctgctcaattcacgccgcccgccgtctgccctgcagacacctctttgcagcgcgcctcctcactggggctgccttattccacatggacctgctcagggattgctgggggagagccccagagccctgacccttcatgcctctgcccaccaccctccaccaggagggtcggagggcattcttcgatcccaaagataatagggctgaggccaaggagaccgttgcagtccccctggccaccttctgggtcatccagggacctcctcatggcagtttgcctctctgggtccaagggcaagctgtaagtggtctctgaggtcctggagccacagcttgggaaggtgttgatgggcagggtggattctgagggcttccctctggagaggaagcatgtgatgagaggtgtagacagggtcaggctgggacagaaggaaggaaaggggcagagctggggggagggggaggaagcgatcatatggggagtgtctggcaagagtagactggccagtctagggagtgcagcggggagaggggaaagggagaaagtacagaagacagatgaaggagaggaggtaagcgagaaaaaatggaaaggggagccggaaatggaggagagaggacaagcaaagagacagaaatgaagacatgaggaaaagctgggggaagcaggagaggaagggacgggatgtaggagggggaagaaaaatcggagatgagacaaaagaaatgtgtgggagacgggtagagacgaaatgcaaggggcgtggttttggtttttctccaagacctggagacatcgacccccatcgccttctgaagagagagggagggcgggcactgggggtcaggagagtctccagcaggggaggggaattgtttggactattgttcttcaggattggaataaaacaatcttattttgg

SEQ ID NO: 118733 - DNA, 896 bp, Homo sapiens
  Payload ID: 3240
  Gene Symbol: C19orf70
  Gene Name: chromosome 19 open reading frame 70
  Uniprot ID: Q5XKP0
  ENST ID: ENST00000309324
  CDS Start-End: 411-767
ccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtg

SEQ ID NO: 118734 - DNA, 577 bp, Homo sapiens
  Payload ID: 3240
  Gene Symbol: C19orf70
  Gene Name: chromosome 19 open reading frame 70
  ENST ID: ENST00000587589
  CDS Start-End: 3-269
ccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaa

SEQ ID NO: 118735 - DNA, 769 bp, Homo sapiens
  Payload ID: 3240
  Gene Symbol: C19orf70
  Gene Name: chromosome 19 open reading frame 70
  ENST ID: ENST00000590389
  CDS Start-End: 46-378
ttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaatacaaaaattagcctggtatggtggcgcacttgtagtcccagctacttgggaggctgaggcaagagaatcgcttgaacccagg

SEQ ID NO: 118736 - DNA, 655 bp, Homo sapiens
  Payload ID: 3240
  Gene Symbol: C19orf70
  Gene Name: chromosome 19 open reading frame 70
  ENST ID: ENST00000587950
  CDS Start-End: 104-526
agcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtg

SEQ ID NO: 118737 - DNA, 674 bp, Homo sapiens
  Payload ID: 3241
  Gene Symbol: C19orf71
  Gene Name: chromosome 19 open reading frame 71
  Uniprot ID: A6NCJ1
  ENST ID: ENST00000329493
  CDS Start-End: 25-654
ggagcccgggggatccaggcagacatgcaaaccctcaggcaagaggctgcacggccctgtatcccctcggggaccctcgaggccagcttcccagcaccgctgtacagcgatgactacctgtccctggagggttcccgctggccaccagccatcaggcaggccacacgctggaagtacacgcccatgggacgggacgcagccggccagctgtggtacacaggcctgaccaactcggacgcctgggaagcctggtacaacctgccacgggccccggccagccccttccgcgaggcctacaaccgctggcacagctgctaccaacaccgtgagtgcagcatgccatcggcctacacccagcacctgcgggagaccgcctggcatgaccccatcgtccctgcccagtaccaggcccccagcacccggtgggggagcgcgctgtggaaagacaggccaatccggggcaaggaatacgtgctcaacaggaaccggtacggggtggagccactgtggagggcatcagactacgtgccctccctgtcggcaccccagcgcccgcccggcaccacccagaactaccgggagtgggtcctggaaccatactgcccctccacctgccagcggtccccgccttccctcacacccactccccgataaaggcatgctaccaggatgca

SEQ ID NO: 118738 - DNA, 744 bp, Homo sapiens
  Payload ID: 3242
  Gene Symbol: C19orf73
  Gene Name: chromosome 19 open reading frame 73
  Uniprot ID: Q9NVV2
  ENST ID: ENST00000408991
  CDS Start-End: 119-508
gatgtcacctggagcgagtagcgcgcggcgtggaacgcgagtcgcgaccccggctcccggcagtggcgcgcactagccctcgcgccgcacgggacacgagggctgggcgggcagcgggatgaggctaaaggttggatttcaaggcgggggctgcttccggaaagacgcgctgtgtttggaaggtggagtgagcgcccggtgggcgagggcacctcattctgcacccctgcgcccgcctcgggaactgcacgcggcacccccacccgcgactcccacgcagacagtagtgcggcctgcagggttcccccggcggacgaggctaatggttcgctccgccccgcccacacagaggccgcccactggctccggctgcgtttcaggactctggaggaagggacttggccttcgccctcagacgctcttaagggtaggcagcgttgtcctcagttctgccccagcactcagacccagactgggtccctgcctccgccctccgccctcggactagtctcttggaagccggcctgtctccgccttcagacctagggagaggtcttaacctctgttctcagactctggaaaaggcttctcaacggcttggcctgacctcagctcctcgcattccctccacatctcaagacaccaacccagggatgcaggacagacacacagacactcagtgagggtcaaatatctttaaataaagtgccaggaacaataaatactgtacaggaagagagtgca

SEQ ID NO: 118739 - DNA, 872 bp, Homo sapiens
  Payload ID: 3243
  Gene Symbol: C19orf80
  Gene Name: chromosome 19 open reading frame 80
  Uniprot ID: Q6UXH0
  ENST ID: ENST00000252453
  CDS Start-End: 20-616
ataccttagaccctcagtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctca

SEQ ID NO: 118740 - DNA, 504 bp, Homo sapiens
  Payload ID: 3243
  Gene Symbol: C19orf80
  Gene Name: chromosome 19 open reading frame 80
  ENST ID: ENST00000591200
  CDS Start-End: 74-373
actgggagacagaaggggccggtcctcaggcgcccgtgctgcagcagtgggatccactggggagaggctggagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcaca

SEQ ID NO: 118741 - DNA, 432 bp, Homo sapiens
  Payload ID: 3243
  Gene Symbol: C19orf80
  Gene Name: chromosome 19 open reading frame 80
  ENST ID: ENST00000587543
  CDS Start-End: 1-176
cagcccaggaacttcgggcaagcctgttggagactcaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctca

SEQ ID NO: 118742 - DNA, 1223 bp, Homo sapiens
  Payload ID: 3243
  Gene Symbol: C19orf80
  Gene Name: chromosome 19 open reading frame 80
  Uniprot ID: Q6UXH0
  ENST ID: ENST00000616433
  CDS Start-End: 371-967
acatacatcgggtgtgagcacggaatagctgggcggcggctggtccacagacactgggagacagaaggggccggtcctcaggcgcccgtgctgcagcagtgggatccactggggagaggctggagaccaccggtgtgaaggcctcgcgggtaaattcactgcagctggacttgccaaagatgacctgggagagtggattcatgagggacccatgggggatgccctaccccccttccctggggcacagccactgaccggcagagcctggctggggtcctcgcctgtcatgtactgcactcgcacagcaaggttgcgcacggagccctggcggctgctgaagttgaggctgttataccttagaccctcagtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctca

SEQ ID NO: 118743 - DNA, 493 bp, Homo sapiens
  Payload ID: 3244
  Gene Symbol: C19orf81
  Gene Name: chromosome 19 open reading frame 81
  ENST ID: ENST00000458538
  CDS Start-End: 22-493
cttctcctaggagccctccttatggacctggagaccccagaggagatgcaggctcggagcctgggcaggcccatcaaatcctcaaagcagtacctgcggcaggtcattgcagagtacgaggcactggaccgagaactcccgtgcatccggaagttccccacaccaccagcttcccagcccctctgcctctgcatggagaccttgcccgaggaggattttacccacctggaggtgctgcaagccctggaggcccagttaccaggggccatggagagcgggcgcgtgagcagcatccgctttgagaacatgaacgtcatctgtgggactgctgggcgccggaaccggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggc

SEQ ID NO: 118744 - DNA, 765 bp, Homo sapiens
  Payload ID: 3244
  Gene Symbol: C19orf81
  Gene Name: chromosome 19 open reading frame 81
  Uniprot ID: C9J6K1
  ENST ID: ENST00000425202
  CDS Start-End: 1-597
atgcagccagaggtggagcccgtgtgcttccctgccatgggcagccccaccatgcacaggaaggcaggagccctccttatggacctggagaccccagaggagatgcaggctcggagcctgggcaggcccatcaaatcctcaaagcagtacctgcggcaggtcattgcagagtacgaggcactggaccgagaactcccgtgcatccggaagttccccacaccaccagcttcccagcccctctgcctctgcatggagaccttgcccgaggaggattttacccacctggaggtgctgcaagccctggaggcccagttaccaggggccatggagagcgggcgcgtgagcagcatccgctttgagaacatgaacgtcatctgtgggactgctgggcgccggaaccggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctgacgcccgggcgggccccggcagcgcttgcgcaccgccccgcgggctggggccacccacccggagccccggaggacagggggcgttgccttcccaggaaggaggcggggccggctcgagggggtggatactgtgagtttaattataaagaatgacctggtacaaaagcca

SEQ ID NO: 118745 - DNA, 1318 bp, Homo sapiens
  Payload ID: 3245
  Gene Symbol: C19orf84
  Gene Name: chromosome 19 open reading frame 84
  Uniprot ID: I3L1E1
  ENST ID: ENST00000574814
  CDS Start-End: 63-623
gggcccccgaaggatctcggaggcgaagttgctagaagatacgtaagagggccccagtggagatggaacaaccaaaggacggggctgggcctgaagggaacaacctgtccctgccgtcatctgggaccgagccatggccccctgcgcctctcccagcccctccacccttgctcctgaactccacagaccccacccacctggggctcccggagagcgtggcctctgtcaccgtgcccatacgcctggacaccctctcctgcctcctgcacagcgccctgctgggggcctacaccttccaacaggccttgccctcttgcccctgctgctcccaggcaggccactcccagccgggggcagttaggaggcctcccaggggacgcggaggctgggaagtcaggcacaggccaggctggggccgaggcctgcatcgacggggccttgggagagctgagcagccagagaggggccgggcggggggccctggggctggccccaggaccccaccaatgacactgccatcaccaccaacactgcctgcccaggatgggaagaaagaagctcgaggtccagagccacccctggaaacaccactggctgctgaggactgggagacagagtactaggaccttggagggtcaggcacctgagattgcagtcacccaggagggttttcctggggcccagagtgatctcagccctgtcagaagaaccccaagaaacatcttccatcctcccctctccccaaaaccacaatcccaggagtagctcctgtgaggcacttggtgaacctgacctaagtcacctgaatcccaagtgagaagaaaatcctaaacctcgtacccaaacctgtctccttgatggcctcaaccccattcccaatgccatccccaaccacaaccacaatccttacctcattctcaacccccagggctcctccaaccccattccctatcctctccctaatcccaaagccactcctacctgcctctctcttccccactctcaataccctgttcccaaacccattcattcccatccctgtcaccagtcccagctccacttctgcgcctcaaccctaacccaccctctttaccaacccctttctcctcattgcctgtgtacctcagcccatctttaatgtcctctgaatctacagccccaaagagctccatcctcaacctcagccacagccctgtgtccatccccacaaagaaccgcattggccccacatacccagacacctgtgactccccaccccactgcctgctcttcaggtagaaagccctggttgaacaataaacgcatgactctccctgaa

SEQ ID NO: 118746 - DNA, 788 bp, Homo sapiens
  Payload ID: 3245
  Gene Symbol: C19orf84
  Gene Name: chromosome 19 open reading frame 84
  ENST ID: ENST00000570516
  CDS Start-End: 625-741
ggatctcggaggcgaagttgctagaagatacgtaagagggccccagtggagatggaacaaccaaaggacggggctgggcctgaagggtgagacaaacaaagacctcctgagagggggacagagacccagagagaggaggggacagagaaaacgagagagaaagggcgcgctgaacagacctgcatagagaatcaggaaaaacaaaaaaggctcaggaacaacctgtccctgccgtcatctgggaccgagccatggccccctgcgcctctcccagcccctccacccttgctcctgaactccacagaccccacccacctggggctcccggagagcgtggcctctgtcaccgtgcccatacgcctggacaccctctcctgcctcctgcacagcgccctgctgggggcctacaccttccaacaggccttgccctcttgcccctgctgctcccaggcaggccactcccagccgggggcagttaggaggcctcccaggggacgcggaggctgggaagtcaggcacaggccaggctggggccgaggcctgcatcgacggggccttgggagagctgagcagccagagaggggccgggcggggggccctggggctggccccaggaccccaccaatgacactgccatcaccaccaacactgcctgcccaggatgggaagaaagaagctcgaggtccagagccacccctggaaacaccactggctgctgaggactgggagacagagtactaggaccttggagggtcaggcacctgagattgcagtcacccaggagggtt

SEQ ID NO: 118747 - DNA, 1667 bp, Homo sapiens
  Payload ID: 3246
  Gene Symbol: C2orf15
  Gene Name: chromosome 2 open reading frame 15
  Uniprot ID: Q8WU43
  ENST ID: ENST00000302513
  CDS Start-End: 637-1014
gagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaa

SEQ ID NO: 118748 - DNA, 1058 bp, Homo sapiens
  Payload ID: 3246
  Gene Symbol: C2orf15
  Gene Name: chromosome 2 open reading frame 15
  Uniprot ID: Q8WU43
  ENST ID: ENST00000409684
  CDS Start-End: 468-845
tcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagtgccacctgtgatatatgtgaagttcctgaaatacctaagtccaagttacagctctgtcatattctactgattatttgttcctgtacctgtacaagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaa

SEQ ID NO: 118749 - DNA, 6199 bp, Homo sapiens
  Payload ID: 3247
  Gene Symbol: C2orf16
  Gene Name: chromosome 2 open reading frame 16
  Uniprot ID: Q68DN1
  ENST ID: ENST00000408964
  CDS Start-End: 52-6006
gttaaatctgtggcctttgcatcgaagccatgctttcaagatgtaaaacctatggagctgacaccaggggcccaacagcaaggtataaattatcaagagttgacttcaggatggcaagatgtgaaatcaatgatgttggtaccagagccaactaggaagttcccatcaggaccactgttgactagtgtcagattttcaaatttgtctccagaatcacagcaacaggatgtgaaatctttggagtttactgtagagccaaagttgcaaagcgtaaaacatgtgaaattatcttcagtgtctctgcagcaaactataaaatctgtggaattagcaccagggtcactgcctcaaagagtgaaatatggggagcaaactccaagaacaaattatcaaatcatggaatcctctgaactaatccctagaccagggcatcagtttgcaaaatatgcagagatgatcccacagccaaagtatcaaatccctaaatctgcaaatttgatttcaataccaatttatcacgccacagaatcttcagaaatggcacaaggattggcatataaaggcatagatactgtagagaaatctgtggggttgaccccaaagctaacaggtagagctaaggaatccttagggatgctgctgcagccagatcttcaggtaccaaaatttgttgatctgactccaatggtaagggatcaaggctcaaaattcttaggattaactccagagaaaagctaccaaatcctagaaactatggaattgctctctcagtcacggccccgagttaaggatgtgggggagttatatatgaagccactgcagcaaactgtggaatatgaagggattactccggaactcaagcattactttacagaagctatggggttgaccgctgaggcaaggatacaagcaaatgaattctttggaatgaccccaaagccaacaagtcaagccactggatttgcagagagatccccaaggctctgtcctcaaaacttagaatgtgtggaggtgatctctgagaaaagactgcaaggggaagaatctgtggtattgattccaaagtcattacatcacgtcccagattctgcttcagggatgacacctgggttaggacatcgagttcctgaatctgtggagttgacttctaagtcaggagtgcaggtagagaaaactttgcaattaacccccaaaccacagcatcatgtgggatctccagggataatatcagggttaggacatcaagtcccagaatctgtaaatctgacctgtaagcaatggctacaaatggaggaatctttagaggtgcccctgaagcaaacaagtcaagttataggacatgaagaatctgtagagctcacctctgaggcacggcagcacagggaggtatcaatggggctaacaaagtcaaagaatcaaagtatgaaatctccagggacaaccccaggaccactgggtcgaattgtagaatttatgaggattagtccagagccactagatcaagtcacagaatctgcaaggacacagcttcaagttgctcaatctgaagaggtaatcctcatagatgtcccaaaagttgttcaatctgtgaaagtgacccctggaccaccatttcaaattgtaaagtctgtgacgataccaaggccaacccctcaaatggtagaatatattgagttgactccaaaactgcaatatgtgagaccttcagagcaccacacagggccatgtttgcaagatgtgaaatctacaaaattaatcacaaagccaaaacaccagattttggaaacagtggagttgacagggtttcaaattgtaaaaactatgttaatcccagggccatcccttcaaatcgtaaaatctgaggagttagcaccaggaccaattcctcaggttgtagaaccaataggagtagccctagaatcaggaattgaagcaataaattgtgtggatttacttccaaggccacatcttcaagaactgatagtacctgcagaattaactccaagtccatgtactcaagtgaagtctgcagaattaacctcaccgcaaacatctccatttgaggaacatacaatattgactcataaacaagggcttcaggctgtgaaatctacagtgataaaaacagagcctcctaaagttatggaaactgaggatttgaatctaggacacgtgtgtcagaatagggactgtcagaagttaacatcagaagagttacaagtagggactgacttctctaggttcctacaaagctcttcaaccacactcatttcaagctctgtcagaacagcatctgaattaggaggactttgggattctgggatacaggaagtatccagagctttggatataaaaaaccctgggacagatattttgcagcctgaagagacctatatagaccctactatgatacaatctttaacttttcctttggcccttcataatcaaagctccgataagacagctaacattgtggaaaacccatgtcctgagattctaggagtggatgtaatatctaaagagacaactaagaggaagcaaatggaggagctagagaactcacttcagagacatctaccacaaagctggagatcacgatctaggacattccaggcagaatcaggggttcagaaaggtctcatcaagtctttcccgggcagacaacacaatgtctgggagagtcatgcctggaggcagcgactaccaagaaaatatctctccactatgctaatgctggggaatattttagggaccactatggaaaggaagctttgttctcaaacatctttagcagaaagagccactgcagatacctgtcaatctattcagaatttatttgggattccagctgaactgatggaaccttcccagagcctgccagagaagggtccagttactatttctcagccttctgtggtcaaaaactatattcagagacatactttttatcatggtcataagaaaagaatggccttaaggatatggacacgtggctccacatcttccataatacagcaatactctgggactagagtgagaataaagaagacaaactcaacgttcaatggtatatcccaagaagtcattcaacatatgcctgtctcatgtgcagggggccagcttcctgtcctggtaaagtcagagtcttccctcagcatattttacgatagagaagatcttgttccaatggaagaaagtgaggactcacagagtgattcccagacaaggatttctgagtcccaacactccctcaagccaaattatctttcccaggccaagactgacttctcagaacagttccagttgctagaagatctgcagctaaaaatagcagcaaaactcttaaggagtcaaataccccccgatgtgcctccacctctagcttcaggtctagtcctaaaataccctatctgcctacagtgtggccgatgttcaggacttaattgccatcataaattacagaccacttcggggccttatcttcttatctatccacagctccaccttgtacgcactcctgaaggccatggtgaggttcggttgcatcttggctttaggctgagaattgggaaaagatcccaaatctcaaagtatcgtgaaagagatagacccgtcatacggagaagccctatatcaccatcacaaaggaaagctaaaatctatactcaagcttccaagagtcctacttccacaatagatttgcagtctgggccttcccagtcccctgctcctgtacaagtctacatcaggcgaggacaacgcagcaggcctgacttagtagaaaagacaaaaactagagcacctgggcactatgaattcactcaagttcacaacctaccagagagtgactctgaaagcactcagaatgaaaaacgggctaaagtgagaaccaaaaagacctctgattcaaaatatccaatgaagagaatcaccaagcgacttagaaaacacagaaagttctacacaaacagtagaaccacaatagagagtccttctagggaattagcagcccatttaagaaggaagaggattggagcaactcagacaagtactgcctctttaaaaagacaacctaagaaaccttcccaacccaagttcatgcaactgctttttcagagcctaaagcgggcattccaaacagcacacagagttatagcttctgttgggcggaagcctgtggacgggacaaggccagacaatttgtgggcaagcaaaaactattatccaaaacaaaatgccagggactattgcttaccaagcagtatcaaaagagacaagaggtcagctgacaagctaacgccagcaggctcaaccattaagcaggaggacatattgtggggaggaacggtccagtgcagatcagctcaacagccaagaagagcttactctttccaacccagacctcttcgactgcccaagcccacagattcccaaagtggtattgctttccaaactgcctcagtggggcagcctctgagaactgttcaaaaggacagtagtagcagatcaaagaaaaacttctatagaaatgaaacctccagccaggagtctaagaacttgtccacaccaggaaccagagttcaggcccgaggaagaatcctacctggttcccctgtgaagagaacctggcaccgacatcttaaagacaaactcacacacaaggagcataaccaccccagcttctatagggagagaaccccacgcggtccttctgagagaacccgtcataacccctcttggagaaaccatcgcagtccctctgagagaagccaacgcagttccttggagagaagacatcacagtccctctcagaggagccactgcagtccctctaggaaaaaccattccagtccttctgagagaagctggcgcagtccgtctcagagaaatcactgcagtccccccgagaggagctgtcacagtctctctgaaaggggccttcacagtccctctcagaggagccatcgcggtccctctcagagaagacatcacagtccctcagagagaagccatcgcagtccctcagagagaagccatcgcagttcctctgagagaagacatcgcagtccctcccagaggagccatcgcggtccctcagagagaagccattgcagtccctctgagagaagacatcgcagtccctctcagaggagccatcgtggtccctctgagagaagacatcacagtccctctaagagaagccatcgcagtcccgctcggaggagccatcgcagtccctcagagagaagccatcacagtccctctgagagaagccatcacagtccctctgagagaagacatcacagtccctctgagagaagccattgcagtccctctgagagaagccattgcagtccctctgagagaagacatcgcagtccctctgagagaagacatcacagtccctcagagaaaagccatcacagtccctctgagagaagccatcacagtccctctgagagaagacgtcacagtcccttggagaggagccgtcacagtctcttggagaggagccatcgcagtccctctgagaggagatctcacaggtcctttgagaggagccatcgtaggatttctgagagaagtcacagtccctcagagaagagccacctcagtcccttggaaagaagccgttgcagtccctctgagaggagaggacacagttcctctgggaaaacctgtcacagtccctctgagagaagccatcgcagtccctccgggatgaggcaagggaggacctctgagaggagccatcgcagttcctgtgagagaacccgtcacagtccctctgagatgaggccagggaggccctctgggaggaaccattgcagtccctctgagaggagccgacgcagtccccttaaggagggactcaagtacagtttccctggagagaggcccagccatagtttgtctagagatttcaagaatcaaacaactctcctcgggaccacacataaaaatcccaaagcagggcaagtgtggaggcctgaagctactcgatgaggcgaggtccgcccctattattcattgtcctaagtcttcatcgtgctgccctttccaggcttctttcctgctcagccactgcctccaattcctgcgcccccagcgtggaaaggcttccatttctctctaccgggggggaggcgggtgagaatgggtctgtaatttctctaagatgaataaaggggcagtaaat

SEQ ID NO: 118750 - DNA, 789 bp, Homo sapiens
  Payload ID: 3248
  Gene Symbol: C2orf40
  Gene Name: chromosome 2 open reading frame 40
  Uniprot ID: Q9H1Z8
  ENST ID: ENST00000238044
  CDS Start-End: 110-556
gggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaagaaaagtct

SEQ ID NO: 118751 - DNA, 799 bp, Homo sapiens
  Payload ID: 3248
  Gene Symbol: C2orf40
  Gene Name: chromosome 2 open reading frame 40
  ENST ID: ENST00000409944
  CDS Start-End: 232-570
aatctgctggggccttagtcttgaatttccagcctccataactgtgcaaaatccatttctgttgcttataagctacccagcttatgggattttgtttagcagcccaaatggactaagacactcaatgttagaagacttctttctccttcctgctggagaaattcaactgcattgcatggagagctaattatatggagagacagtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaagaaaa

SEQ ID NO: 118752 - DNA, 602 bp, Homo sapiens
  Payload ID: 3248
  Gene Symbol: C2orf40
  Gene Name: chromosome 2 open reading frame 40
  ENST ID: ENST00000437659
  CDS Start-End: 176-602
cctgaccgggctggcgctgctcctgctcctgtgctggggcccagaccccctggagcctgtccatggaaggagaggctaagaaccctgctgagaaagtggtcaccattacctccatcctggggcctgactccagttccttacacccgaagttgctctactcactacttacgatgtcatgcaacagttaagggtcagaggctcctataggtctgcaagccagttcgctgggtggaggcgtgtgttctatcaggccagacaaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggag

SEQ ID NO: 118753 - DNA, 2581 bp, Homo sapiens
  Payload ID: 3249
  Gene Symbol: C2orf42
  Gene Name: chromosome 2 open reading frame 42
  Uniprot ID: Q9NWW7
  ENST ID: ENST00000264434
  CDS Start-End: 381-2105
acttgccgcgcgtgggcggctctgaccaataacgattgtcgttacagcgaacagtttggccccgtttgtaaaaggccgcggcaggcgaagagagaagagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcactagtttttcctaattata

SEQ ID NO: 118754 - DNA, 578 bp, Homo sapiens
  Payload ID: 3249
  Gene Symbol: C2orf42
  Gene Name: chromosome 2 open reading frame 42
  ENST ID: ENST00000425268
  CDS Start-End: 402-578
agcaaggaccggggcggcggtggggcaggggtgtagagctcgggttcccagcggaaagcatgtccaaggagcggctgccggcgaggtgatgcttctgcctgggcctacttgggaccggaaactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcct

SEQ ID NO: 118755 - DNA, 536 bp, Homo sapiens
  Payload ID: 3249
  Gene Symbol: C2orf42
  Gene Name: chromosome 2 open reading frame 42
  ENST ID: ENST00000419381
  CDS Start-End: 154-536
actatcaagatctccacttagggaagtgggaatcttatttgcggaacattgggcagaagctttgccattggctggtggagaaggaggaggcagaatgtctgcattgttacaccatacagctcaaacttcagaagattttggggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgt

SEQ ID NO: 118756 - DNA, 1133 bp, Homo sapiens
  Payload ID: 3249
  Gene Symbol: C2orf42
  Gene Name: chromosome 2 open reading frame 42
  ENST ID: ENST00000457952
  CDS Start-End: 798-1133
ggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttgtgagttacctgctggctgtgacgcttccgtcaaatctgagtaacagtttcctcatctctaagatgggtaacatagtatctacctcacaggatcgtgtgggcagtacatgcatagaaaggatttaacacgcagtgtactcagctagttttattatttatccgtaatgatcatttgttcttttcccctaactgtgcctcacaagcatgaaacagaatccaccaaacatttaggtctgggtagtggttggatggaaacccatcgcgggttaacgcttccaacaccagtcccttgacactctcccgccgaggaggctgatttgtaaacttgctgagaagagaatacccagcagatctttcagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctct

SEQ ID NO: 118757 - DNA, 548 bp, Homo sapiens
  Payload ID: 3249
  Gene Symbol: C2orf42
  Gene Name: chromosome 2 open reading frame 42
  ENST ID: ENST00000428010
  CDS Start-End: 369-548
gtaaaaggccgcggcaggcgaagagagaagaggtgagggcggtcgtcagctaagggccccggggctcgcggggggtgcgcagggcagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagt

SEQ ID NO: 118758 - DNA, 563 bp, Homo sapiens
  Payload ID: 3249
  Gene Symbol: C2orf42
  Gene Name: chromosome 2 open reading frame 42
  ENST ID: ENST00000447804
  CDS Start-End: 58-563
tttggccccgtttgtaaaaggccgcggcaggcgaagagagaagagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccat

SEQ ID NO: 118759 - DNA, 551 bp, Homo sapiens
  Payload ID: 3249
  Gene Symbol: C2orf42
  Gene Name: chromosome 2 open reading frame 42
  ENST ID: ENST00000417203
  CDS Start-End: 485-551
aaaaggccgcggcaggcgaagagagaagagacccatcccggaagccggccgggaggtgagcgtcccggagtcgggcggccgctccgttgactgcagggccccggcggtcttcctccgctgttccgaggccgttgagggctgatgtgctccatcctcccacttgtggtttggcaagccatccagccgactacaaacccacgtttactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattga

SEQ ID NO: 118760 - DNA, 2193 bp, Homo sapiens
  Payload ID: 3249
  Gene Symbol: C2orf42
  Gene Name: chromosome 2 open reading frame 42
  Uniprot ID: Q9NWW7
  ENST ID: ENST00000420306
  CDS Start-End: 11-1735
cctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatgcaggcctccccggaaaccaaacagaccatctggcagttggccacggaacccacaggtcctctggtgcagagaattactaaaaacatcttggtggtgaaatgcaaggcaagccagaagcacagtttggggtatttgcatacatcttttgtgcagaaagtcagtggcaaaagcttgcctgagcgccgcttcttctgctcctgtcagactctgaaatcgcacaagtcaaatgcctccaaggatgagacagcccagagatgcattcatttctttgcttgcatctgtgcctttgccagtgatgagacactggctcaggaattctcagacttcctaaattttgattccagcggtcttaaagagattattgtaccccagttaggttgccattcagaatcaacagtatctgcttgtgagtctactgcctctaagtcaaagaagaggagaaaggatgaagtatctggtgcacagatgaacagttcactactgcctcaagatgcagtgagcagtaatctaaggaaaagtggcctgaaaaagcctgtggttgcttcctcgttaaaaaggcaggcctgtggtcagctgttagatgaggcacaagtgactttatccttccaagactggctggccagtgtcacagaacgcatccatcaaaccatgcactatcagtttgatggcaaaccagaaccattggtgttccacattcctcagtcattttttgatgccctgcaacaaagaatatctataggaagtgcaaaaaaacggctccccaactccaccacagcttttgttcggaaagatgccttgccactgggaaccttttccaagtatacttggcatatcactaatatcctgcaagttaaacaaatcttagataccccagagatgcccttggaaatcacccgtagctttatccagaaccgagatgggacttatgagctatttaaatgccctaaagtggaagtagaaagcatagcagaaacctacggtcgtatagaaaaacaaccagtgctgcgacccttggaactaaaaacttttctcaaagttggcaacacttccccagatcaaaaggagccaacacctttcatcatcgagtggatcccagatatccttccccaatctaagattggcgagctgcggatcaagtttgagtatggccaccaccggaatgggcatgtggcggagtaccaagaccagcggccccccttggaccagcccttggaactggcccctctgaccactattactttcccttaaagcaaaacaagataataatcttttgctgcttaatttgcacatccccaccccttgacaactttaaatgctagttaggcacttagatggccctgttccttggtaaactgctcttagctaagatgcaaattctcagtgctttcaagtggattctgttgaagaaaatctcttgtaaatagcctttttgatgctgctgtgtacagtcttcattatgcattgggcagtatttctggctagagttttaaaaggaacagaaagaaaaccagcttattttccttcttacggactcatctttagcgtttatttcaaccttttgctaattctctgagaaatctgcagcactcagccatacaccaacagtgttggaaagttaacaccctggttagggcagaatgttaaagaccatcttggcagagttccagccacgctctttattctgttctcaaataaagcagtgtcac

SEQ ID NO: 118761 - DNA, 662 bp, Homo sapiens
  Payload ID: 3249
  Gene Symbol: C2orf42
  Gene Name: chromosome 2 open reading frame 42
  ENST ID: ENST00000428751
  CDS Start-End: 569-662
aagaggtgagggcggtcgtcagctaagggccccggggctcgcggggggtgcgcagggcaggtaagggggtagtgctgagcaaggaccggggcggcggtggggcaggggtgtagagctcgggttcccagcggaaagcatgtccaaggagcggctgccggcgaggtgatgcttctgcctgggcctacttgggaccggaagtgagcgctcgcgcggggaggatgccgggaagcaggtcccaggggatatgtgtgtgtcgctgcagacccatcccggaagccggccgggagactatcaagatctccacttagggaagtgggaatcttatttgcggaacattgggcagaagctttgccattggctggtggagaaggaggaggcagaatgtctgcattgttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaaatggaaccaaattctctgaggactaaagtcccagctttcttatctgatttggggaaggccacattgaggggaatcagaaagtgtccccgatgtg

SEQ ID NO: 118762 - DNA, 576 bp, Homo sapiens
  Payload ID: 3249
  Gene Symbol: C2orf42
  Gene Name: chromosome 2 open reading frame 42
  ENST ID: ENST00000417865
  CDS Start-End: 100-576
gtaaaaggccgcggcaggcgaagagagaagaggtgagggcggtcgtcagctaagggccccggggctcgcggggggtgcgcagggcagggcctctgaaaaatggaaccaaattctctgaggactaaagtcccagctttcttatctgatttggggaaggccacattgaggggaatcagaaagtgtccccgatgtggcacatacaatggaacccggggactgagctgtaagaacaagacatgtggaaccatattccgctacggtgcacgcaagcagcctagtgttgaagctgtcaaaatcattacaggctctgatcttcaggtctactcagtgcggcaaagagaccggggccctgattaccgatgctttgtggagctcggggtttcagagacaacaatccagacagtggatgggacgatcatcactcagctgagctctggacggtgttatgtcccctcatgcctgaaagctgccactcaaggcgttgtggaaaaccagtgccagcacatcaagctggcggtgaactgccaggcagaggccacccctctgaccctgaagagctcggtcctgaatgcaatg

SEQ ID NO: 118763 - DNA, 3817 bp, Homo sapiens
  Payload ID: 3250
  Gene Symbol: C2orf44
  Gene Name: chromosome 2 open reading frame 44
  Uniprot ID: Q9H6R7
  ENST ID: ENST00000295148
  CDS Start-End: 59-2224
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggttattgtggc

SEQ ID NO: 118764 - DNA, 3700 bp, Homo sapiens
  Payload ID: 3250
  Gene Symbol: C2orf44
  Gene Name: chromosome 2 open reading frame 44
  Uniprot ID: Q9H6R7
  ENST ID: ENST00000406895
  CDS Start-End: 67-1935
gggcggccacagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggtta

SEQ ID NO: 118765 - DNA, 562 bp, Homo sapiens
  Payload ID: 3250
  Gene Symbol: C2orf44
  Gene Name: chromosome 2 open reading frame 44
  ENST ID: ENST00000443232
  CDS Start-End: 41-562
aacccactgaccagggagcgtggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggca

SEQ ID NO: 118766 - DNA, 1495 bp, Homo sapiens
  Payload ID: 3251
  Gene Symbol: C2orf47
  Gene Name: chromosome 2 open reading frame 47
  Uniprot ID: Q8WWC4
  ENST ID: ENST00000295079
  CDS Start-End: 323-1198
agttcccagctgtccgaaaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattg

SEQ ID NO: 118767 - DNA, 1386 bp, Homo sapiens
  Payload ID: 3251
  Gene Symbol: C2orf47
  Gene Name: chromosome 2 open reading frame 47
  Uniprot ID: Q8WWC4
  ENST ID: ENST00000392290
  CDS Start-End: 197-1072
cgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactacttacaaa

SEQ ID NO: 118768 - DNA, 737 bp, Homo sapiens
  Payload ID: 3251
  Gene Symbol: C2orf47
  Gene Name: chromosome 2 open reading frame 47
  ENST ID: ENST00000435773
  CDS Start-End: 1-677
taccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggtaaatatctaagtgtggaattgctggattatgagaggaagaggccatgagccaaggagagtgggtggcctctagaagatggaaaagacaaggaaatggattcttcccca

SEQ ID NO: 118769 - DNA, 4768 bp, Homo sapiens
  Payload ID: 3252
  Gene Symbol: C2orf49
  Gene Name: chromosome 2 open reading frame 49
  Uniprot ID: Q9BVC5
  ENST ID: ENST00000258457
  CDS Start-End: 230-928
gacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatctttttaaaccaatggcttagtatatgtcatttatattgaccctactgaaattattagctacaaatgtgctataaagcatccattgaattggccaggcgcagtggctcacgcctataatcccagcactttgagagactgaggtgggcagatcacctgaggtcaggagtttgagaccagcctgaccaacatggagaaaccccgtctctactaaaaaatacaaaattagctgggcatagtggtgcatgcctgtaatcccagctattcaggaggctgagacaggagaatcgcttgaacctgagaggcggaggttgcggggagccaagatcgcaccattgcactccagcctgggcaacaagagcgaaactccatctcaaaaaaaaaaaagcattcagtgaattttcggagttactctcattagccttgttcagagtctttgggggaaatttgagatttttgagattttttttaaaaactcaaatattttactagtttgcctgccattttatttcttttacaaagcagaagcatataccaatttatcacagtattttagtaaatactgcaacattcatccttaaatgttcaccaagaaaagcatctttgtagtagtgctggaaaactattcagaatatacagataaaaatgctgttctttaattgcttacattgcttcttcccataaaaagcaaaaaggaatcagtgcttgctattgctcctttccttgaagttgtaacaattgatacatatattatgagttgactggtcgattctgtacctggcccatcctttagaatgttcttgtcatgtagcagtcctacgtactcttttcatgagcagtctgtgatctcactctgtgagttcagctattactcgctcgtgggagcttaatcttttcaaaatgaagttgatttaaaaagtcttcaggcagagtaatcatgttagaggtggtattcgatggaagaaagtttagagagttaggagtgggggtagaattctagaatttataagagtccaggaagcatagcagtcaggggcaaaaattagcgtaatatggagtaggcaatagaggagctactggagtcagaagtcactgcagagtgcaacataggaagatggactcctagcttacatgagattccctgcagctgtaatatagacaattcccacatggctgttctacacagaattacctgctaagattttttgtttatttttgtttgagtggtattttcactccaattgtataatggaaatcagtgggaaaatagggtttaccttatattcatgagttctagtttctactgttctgctatgtgtttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtcactacatgttgagggatggaaatagaagtctctgaacttcccatgtaatattaaagctcttaacaaaatgagacaaactagagattcagttgagagattttatgttagagtgatctgaaaaaaagttaatttctaaactgctatcttaatattattatatttggagactgatgctgtaaattaaataacttggaaaaga

SEQ ID NO: 118770 - DNA, 854 bp, Homo sapiens
  Payload ID: 3252
  Gene Symbol: C2orf49
  Gene Name: chromosome 2 open reading frame 49
  ENST ID: ENST00000410049
  CDS Start-End: 57-629
aacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatcttttt

SEQ ID NO: 118771 - DNA, 2684 bp, Homo sapiens
  Payload ID: 3253
  Gene Symbol: C2orf50
  Gene Name: chromosome 2 open reading frame 50
  Uniprot ID: Q96LR7
  ENST ID: ENST00000381585
  CDS Start-End: 283-771
cctttcctaggagctgtccgttcccaggacaacagtcaacacagcacaggcgggagttcaaaacgaaactgggctcaaatgctctccccagcccggagagccctgtccccatcggccactctgagctcgaggcctaaagggacagtgaggaggaccctgcccaggctctcccggggttaggagggacagagtgttccaggaggaggtttgagctgagctcaggcacaggtctctctctctctctctctgacacaagcgcacacacacacacacacttgcaccatggggagccaccccacccctgggctccagagaaccacatcagctgggtaccgattgccccccaccaggccaccagcctcggtctccccagctgcccggggtggccctatggccagcaggggtcttgctggtggctgccaggccccccaggctctgaaggcgcagcgggtggctcagggagctgcctgcgatggcgtgcagcaggaccagctgtggcgggagctcctggaggccgagcggcggggccagcagcgctggattcagaactggagtttcctgaaagactatgacccaatgggcaacaagaaggagcctgagaagttgccagaccatgtgcctctcttttcggacacagttcccagttccacgaaccaggttgtgggcagcaggctggacacacccctgggacagactctcatccgcatggacttcttcttcacagaaggggcccggaagaagaagctggaggaccagatgcagcccatctaggagcaaggagggctgggctggccttccccaggtgggtgtgggtggggacaagagacccagcccacaacagcaccagtcagctccccacacaaggcagcttgggtctgcactgtctgtaagctgcaggacactcttccaggggacccaaggggtcactcttacacactttttacacgtaagattcagaggagtcagtaactggtccacggccgtacaatccccagcccttccagcttgggaactcatgggtgccccatgaaagggaccctgcattgtggtcaggagcactgaatgcctgggttcaaatccagcttgtgaccctgatgagctgtgggaccttgagctggctgctgcaacactctgtgcctccgtctcccctcctgcgattcagtgtgttcactccttgcagctgctgtgacaagtgagcacaaactgcatagcttaaaacaacacaaacgtatcatcttacagctctgaagatcacaactctgacatgggtgacatgttgcagagctgtgctcttttaggagtatctggggaagaatctatttccacattttttccagtttctcaaggcagcctgtattccttagttggcagctccttactccgtctttgaagccagcatcctagcatcttcaaatcagtctctatcgcttgctctctcctgcctcactccttcatcttttctttctttctctctctctctcttttttttttagagacagtgtcttactctgtcacctaggctagagggcagtgatgcaattataaatcattgtagccttgaactcccgggctcaagcaatcctcccacctcagcctcccaagtagctagggatacagacacatggcaacatgcctggctaattttttttttatttttattccagacagagtctcgcactgtcgcctaggctggagtgcaacagtgtgatcttggctcaccgcaacctccgcctcctaggtccaggcaattctcctgcttctgcctcctgagtagctggaattacaggcatgtgccgccatgcctggctaattttttgtatttttagtagagatggggtttctccatgttggtcaggctggtctgaaactcccaacttcaggtgatccgcctgcctcagcctcccaaagtgctgggattacaggtgtgagccactgcgcccggccatgcctggctaatttttaaaattttatgtagagatagggtctcactatgttgaccaggctggtcttgaacttttgggctcaaatgatcctcccaccttggcctcccaaagcactgggattacaggcatctggtttcacttcctccaccttttaaggacccttgtgattatatcacaacctttatatttaagcaaaaaaatgcagaaaaggcttagttcctctttgttggttaaaacacaaatggattcattctttcaaacatccgcattctcctcttcttcctgggtgctctgccaggctgtggtttcccttggtttgggtggagcatgtgacagagccatggccagtggaatgggagcaaaaaccctaggtctcccttccaggcctggtccatgagacactccaggtattggcttgttctcctttccccatcagctgaagaagggagaggacttggaggatgcagggaagagaggggcacaagatggagggagcatgtcaggaccaagcctggagccctgagtgagctcgtggagcagaatctcccgacacccacactgacacacaaacaaaataaacaaaaactggccaaaacaaaaacaatagcccacacttctagggtaaagcattttaaatttattttctcaacaacccaagagaatcaacaggcagggatttcgtattcatttaatacaggcaaaacctgagattcagagaggtgaaataaaatcccgaacata

SEQ ID NO: 118772 - DNA, 980 bp, Homo sapiens
  Payload ID: 3253
  Gene Symbol: C2orf50
  Gene Name: chromosome 2 open reading frame 50
  Uniprot ID: Q96LR7
  ENST ID: ENST00000405022
  CDS Start-End: 207-695
aaatgctctccccagcccggagagccctgtccccatcggccactctgagctcgaggcctaaagggacagtgaggaggaccctgcccaggctctcccggggttaggagggacagagtgttccaggaggaggtttgagctgagctcaggcacaggtctctctctctctctctctgacacaagcgcacacacacacacacacttgcaccatggggagccaccccacccctgggctccagagaaccacatcagctgggtaccgattgccccccaccaggccaccagcctcggtctccccagctgcccggggtggccctatggccagcaggggtcttgctggtggctgccaggccccccaggctctgaaggcgcagcgggtggctcagggagctgcctgcgatggcgtgcagcaggaccagctgtggcgggagctcctggaggccgagcggcggggccagcagcgctggattcagaactggagtttcctgaaagactatgacccaatgggcaacaagaaggagcctgagaagttgccagaccatgtgcctctcttttcggacacagttcccagttccacgaaccaggttgtgggcagcaggctggacacacccctgggacagactctcatccgcatggacttcttcttcacagaaggggcccggaagaagaagctggaggaccagatgcagcccatctaggagcaaggagggctgggctggccttccccaggagttacacaggacaggacacgttatttccatgcaacagcccctgtgtttcatgccataccctggccctgagcgactgtgtgatggagcagaccaggcccagtgtgacttggccaggaagaggcccaacccttcctacttggatctggaggccaccgccttctttctcagtgtctgacatggaagctgggctccctctccactctgagatcatcagctgggtaaaggtcagtggccaggacagccaggggtcct

SEQ ID NO: 118773 - DNA, 2017 bp, Homo sapiens
  Payload ID: 3254
  Gene Symbol: C2orf54
  Gene Name: chromosome 2 open reading frame 54
  Uniprot ID: Q08AI8
  ENST ID: ENST00000307486
  CDS Start-End: 100-996
atcactggtgctgcaagtcgctgagctgacagttgtgccgaggactgtcaccattgggcaggcatggtggccagctcctcacttggctgaggtccagggatggacacaggtgtctggggttggggagctgcagcctgcaggtgggggccagcagagagggctgcaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaagggtactgtccactttttgtatatcagtgtggaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatt

SEQ ID NO: 118774 - DNA, 1911 bp, Homo sapiens
  Payload ID: 3254
  Gene Symbol: C2orf54
  Gene Name: chromosome 2 open reading frame 54
  Uniprot ID: Q08AI8
  ENST ID: ENST00000388934
  CDS Start-End: 160-1503
actgtgctgtcactctggaattctgctgtgtgggagctgaggccccacctgcagacctgctgctcacctgggcaggtgcctcctcacagcccatctgcacagctggcctgcggagtcctcctcaggggccactggccctcacctgccactgttgaagggatgcctgcccctgctctccccacctcagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctcggagggtgacgccaagtgccgtggacacattgtgcccagcaaggtcctgtgtgtcctcaaggacctgctggtagcagccatcgtacactgcaagcaccacagtctcatcgcaccaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaaggg

SEQ ID NO: 118775 - DNA, 1958 bp, Homo sapiens
  Payload ID: 3254
  Gene Symbol: C2orf54
  Gene Name: chromosome 2 open reading frame 54
  Uniprot ID: Q08AI8
  ENST ID: ENST00000402775
  CDS Start-End: 97-936
actggtgctgcaagtcgctgagctgacagttgtgccgaggactgtcaccattgggcaggcatggtggccagctcctcacttggctgaggtccagggatggacacaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcctggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaagaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacgaaatgctgtatatttggttttgaaaaaatgaatgtgctgggtatacacagcagaaagggtactgtccactttttgtatatcagtgtggaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgaggcctcccagccatgcttcctgtatagcctgcgggactgtgagtcaattaaacctctttattcatta

SEQ ID NO: 118776 - DNA, 549 bp, Homo sapiens
  Payload ID: 3254
  Gene Symbol: C2orf54
  Gene Name: chromosome 2 open reading frame 54
  ENST ID: ENST00000414499
  CDS Start-End: 152-549
gcgagtttctccacctgggtgaggtggagccacggagactgcttttctccagaaccagacgagctccagctcccaggctagcccatctgcacagctggcctgcggagtcctcctcaggggccactggccctcacctgccactgttgaagggatgcctgcccctgctctccccacctcagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctc

SEQ ID NO: 118777 - DNA, 371 bp, Homo sapiens
  Payload ID: 3254
  Gene Symbol: C2orf54
  Gene Name: chromosome 2 open reading frame 54
  ENST ID: ENST00000454476
  CDS Start-End: 47-371
actgcttttctccagaaccagacgagctccagctcccaggctagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctg

SEQ ID NO: 118778 - DNA, 1383 bp, Homo sapiens
  Payload ID: 3255
  Gene Symbol: C2orf57
  Gene Name: chromosome 2 open reading frame 57
  Uniprot ID: Q53QW1
  ENST ID: ENST00000313965
  CDS Start-End: 52-1239
tgaccacaggagagccctagggggaggccggctccaccagcagccccatacatggcactcccagggtaccccctgggcaacgtggatgacagcaggtctaaggacagcccagcaggagagccccaaggtcaggtcccactcacagcagatgtcttggcagtgagcagctctgtcgcatccactgactggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttcccaagtcacctcctgggtaaagacaagatgtcacaaatggcgagtgttcctgagagagagccggagtcagccccctctgccccgagtgctgagctacagtccacccagcacatggaggctcagcccgtcgagagtgatgctgaccatgtcacagcaggtgccaatggccagcatggccctcaggctgccagcaccaccaagtctgctgaggagaaagctgagcatccaaaggccccacaccctgaagctgaagctttaccatctgatgagtccccagtggcaatgggggcaaatgtggtggacagcttaggagacctgcagacttggttcttccctccacctccagcaggcagtgtgtccccgtcgcctggcccccacgaggtggccctggggagaaggcccctggactccagcctgtacacggccagtgaggagaacagctacatgcgctccatgaccagcctgctggacaggggcgagggctccatcagctccctggcagacatcctggtgtggtccgagaccaccatgggcatggccatagccacaggcttcctggattccggccacagcactgtggcagacctgctgcacagctcggggcccagcttgcgctcggtccccagcctggtgggaagcgtcagctcggccttctcctctgggctggtgtcagggaccagctcagccctgcgcaccatcacccgtgtgctggagacagtggagcagaggaccgtggagggcatccgctcagccatgcgctacctgaccagccacctcaccccacgccaggcccaggctgaccccaactatgattagagccctgcacagggacccccgaagggctggttcagtggcctccagagatccctgggaccctcacgccctgctcccttgcccattcttgctctggacggttcccccagcccatgcaataaatcaccagtgagcatttatttctaa

SEQ ID NO: 118779 - DNA, 1621 bp, Homo sapiens
  Payload ID: 3256
  Gene Symbol: C2orf61
  Gene Name: chromosome 2 open reading frame 61
  Uniprot ID: Q8N801
  ENST ID: ENST00000294947
  CDS Start-End: 37-570
gagctcaggttcagcctagagagagaggaggccaccatggaccagccagccgtcgccaccgcttccacctcaataagggaagacctggtgggtggagaatcattcatcacagcttcgaaaccagcccaaaagacttcctcttttgaaagagaaggatggtggagaatagcattaacagatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattcccgtaagtataatgtagacagttaactcatgatgaatttgatgtttaaaatacgctgtgctttctggagtggagcaaggtggccacatagaaccctccagtgatcgttccccctagcaggaacaccattatccacacaattatccacacaagaaaacacctctgtaagaaccaaaaagcaagtgtgggatcgcaataccaggttttaacattgtatcaaggaaagaggcactgaagagggtagggtagaaaagacagtcttgaattactgacactaccctcccccatcccctggcagcagccacgtggcatgaagagagaatctgcccttggggaagagggaatgccgtgacggggggactttgcacgggaacaccgtgctgcctgtaacagggaaagcaacacaggacagaattcagctagtgcccatggagggagcatttagaccagcactagccagccaggaattgcccatcccagccgttcgatactgagttccagctctccctaccactgtgggctgaagtgctctgaggtcctaaataagcttgaaaggcagtctcggccacaaggactgcagttcctgggcaagttcaggtgctctgctgggctcagaggcagtggacttagggtacacaagacctagtgagacaccagctggggcagccaaaggagtgcttgtagcagccatcccccagccccaggcagcacagcttgcagcttcaagagagaggccttccttttgcttgagaggaggagaggggagagtaaagaggacttgtcttgaatctggataccagctcagccacagcagaatagggcacctcaggcagagtcctgaggcccccataccaggccctagctcccagacaacatttctagacacatctctggctggaagagaatccactgccttaaagagaaggacccagttctggcaagattcatcacctactgactaaagagcccttgggcttcgaataaacaccagcagtggccagacaacactcactgcaggccttagccagtgctgtgctgcttcaggtgtgatccagcactttcccagcta

SEQ ID NO: 118780 - DNA, 891 bp, Homo sapiens
  Payload ID: 3256
  Gene Symbol: C2orf61
  Gene Name: chromosome 2 open reading frame 61
  Uniprot ID: Q8N801
  ENST ID: ENST00000445927
  CDS Start-End: 128-874
agcactaaagacaaacctggcgggtcccccggagcggtcccaggcgcgcgcgctcgggagcccacgggccacacccgcctcctagcaaccggagctcaggttcagcctagagagagaggaggccaccatggaccagccagccgtcgccaccgcttccacctcaataagggaagacctggtgggtggagaatcattcatcacagcttcgaaaccagcccaaaagacttcctcttttgaaagagaaggatggtggagaatagcattaacagatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattccccatgaaggccctggtccaggtcattataatgtgaaaatgcctccaacaagctctgtcacttcttgttttcaatccagagtccctcgattcttgcccagctgttcaaaaaccccaggcccaggagcatatacaactttaagacaattccctaagcagtctccgaccatagccaaaatgggccaagagcatagccttttcttcaacaacaacaattggcttttaaaataaagtgatcttggcaccaa

SEQ ID NO: 118781 - DNA, 403 bp, Homo sapiens
  Payload ID: 3256
  Gene Symbol: C2orf61
  Gene Name: chromosome 2 open reading frame 61
  ENST ID: ENST00000449846
  CDS Start-End: 1-386
cacggccaagccccagcacactagttgacaaagatcagtcacttcagctttctccggggcaatacaacgtgcttcctgcaccagttcccaaatatgcttccaggagctgtgtatttcgctcaacagttcaaagattcccaacaacctattttattccccatgaaggccctggtccaggtcattataatgtgaaaatgcctccaacaagctctgtcacttcttgttttcaatccagagtccctcgattcttgcccagctgttcaaaaaccccaggcccaggagcatatacaactttaagacaattccctaagcagtctccgaccatagccaaaatgggccaagagcatagccttttcttcaacaacaacaattggcttttaaaataaagtgatcttggcaccaa

SEQ ID NO: 118782 - DNA, 1669 bp, Homo sapiens
  Payload ID: 3257
  Gene Symbol: C2orf66
  Gene Name: chromosome 2 open reading frame 66
  Uniprot ID: Q6UXQ4
  ENST ID: ENST00000342506
  CDS Start-End: 890-1243
catatttccagctataatccatcatatttccaggtgtatcccttcccttaaaagtaaaaaaggagaaaatcactttgctgtgtggaagtgctttgtgtgttttataaaatccacataaaatgttcgtggttcaaggagtggctgccgcatttctaaggcaaataagcttatccctgaagaagcttgaagatctgactctcaagaatctttgtgttctggatgaaaaaggaatcattattttttaactcccctgctcaagtcagtgacttccactggcacccaatccattggttataagtacccatgaattgccttgccaattataggcaggataacctaggaggaccaaccaaaaccaaactcctggtaagctttattagccttttctacaatgtgtctcagtttctctttcacaccttggagtggaagacaatctctactcacactgttgtggtatgtgtctgtctgtctcagatgtgtgtataaggtgtatttctcagctcggtatctgaagtaatttctttttcttttcttttttttaaagactgctgtcttaaggcttaaaagtaatttaaggttttgttttttgttattttaagagttgcagtttctttggagacaacaaagtactttttttccaaagatgaaaaaggcatattcagactttctatgttatgttccataattgttttgcttatcactgtataacattctcattatcatgggctactttaagctaatcagttgcattttggggtcctcatttagaagtcaatctggaaaaaagatggctgtaaaacttagataaaccagtatgctatttctccttccttgtctgcctttacagatgtttcctctttctctctctcttccctgactatctctctcaatgatcattgacagctcccgcatcccctctttcactcagcttcactccaccatgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctgaaagtttcttctgagctcaggtgtctggctattttaaaactacagatgaagcttctcattagaaaaattcaaccattgtcatagctaaactttcatggagtttctttccccctcacttttatttttcagtttgtaatgattttattccacatttccatatttacatataaatcgctggaactatgatttctatgcatatttatggagtttttttcctatgaaaccataaatattgatgtagagcaccgcatgtatttgtaggagttacaaaaacatcacaaactgaaaaaagattataatctaaattagatgtttctttaagcttgtttttaaaacttgtcttttatgtttattatcttttatcgaccaatatatttttttaaagggacatgctcacttttagtatagtaaaattcattatatgtga

SEQ ID NO: 118783 - DNA, 2837 bp, Homo sapiens
  Payload ID: 3258
  Gene Symbol: C2orf68
  Gene Name: chromosome 2 open reading frame 68
  Uniprot ID: Q2NKX9
  ENST ID: ENST00000306336
  CDS Start-End: 46-546
gttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcagtcattctttcttatatgttgacccatttgcccagcctgatattctggaattcttttttttttttttttttttttttttttgaggattttgtgtggctaatgtgttctagaagcagagactccagggagaaccagaatttatgaagcctcgtgcaacatggtgctttctcaccgaggtcatatgcctggctgctgctgttccactcagctccatgagccacgtttgttattttatgtttcttctgtgcttttgctcatttccacccatgtgtttatagaccttttttcagccctttttctttgttcctttccctcatctttttgcctcaggtagaatccatcagttttcctccccctccaaatgactgtgtacctccagctgctcaggactttggaggtgggggcggggcctggggatctacccttctaaaaaactctccaagtaattctgataccaataaagtgggagacctccatttttgaggcctatttgcaagcatgtctccctccctttccatggctttttcgtttctcgcatgttccactgctttgcactgtctagacaggaaacctaggaagatgttggtgctaaactgaaaagatttcttacagcaaaacctgcctcggccagggctacagaattccaactttcaacttgattcctagccgtgaacagactgtcctctgctcagactaaaagggaattataaacaagtgggaacttactctccagttgtgacttaacagttctgaacatacctacaaagggaaagtcaatattagcaataattgcctgattgacagcacgccagagggaatgaaatgaggccttctctcctacctcccaggagtatgtaactcagatccttagcataaagatccccaggaataccactgctctaacccggtgaacattttttctaatgcagggttaggcttacgtctgaattccacaagacatcctccccctccagtacggaagttccaaggcacttgttttccagcatatcagcctaacctcagtgccttgaaatatggctttaagcctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagaagggcctggtggtgaaagcggccagggaccagaatgctccagacctacagagctggtcaaggttaagtgccttaaacttaccaatcctgggctcagttctcctttgaaaggagaaagtctttgtcctctacttaggcagctgggctagaagtgccttttgacttctaatgttaactaccctccaaagcctcctgggtcaagaaggctctcccaaactccacccctgttcttcctggtcagagaaccagtcagtcattctagtcttctagtccttaaactgatctgatgacttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaa

SEQ ID NO: 118784 - DNA, 1722 bp, Homo sapiens
  Payload ID: 3258
  Gene Symbol: C2orf68
  Gene Name: chromosome 2 open reading frame 68
  Uniprot ID: Q2NKX9
  ENST ID: ENST00000409734
  CDS Start-End: 49-432
gttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgaggtgaggccgcccgccccgcctgcctccagcccgcgcgctcttcctgcaacgcactccccttctctatagggaaaaaccacttcttactcctaaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcaatggtgcgatctgggcttactgcagccttagcctcccgagtacctgggaccacaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaacccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggac

SEQ ID NO: 118785 - DNA, 976 bp, Homo sapiens
  Payload ID: 3258
  Gene Symbol: C2orf68
  Gene Name: chromosome 2 open reading frame 68
  ENST ID: ENST00000423181
  CDS Start-End: 83-259
aaggggcggcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcggtaccgccccgccctgcgccgccgccgccaccactcctggcctggcctggcccggcccgacagtccctgactcccgctcggctccccgcagggacgactatgacaagaaggtgaagcaggcggccaaggagaagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcagtcattctttcttatatgttgacccatttgcccagcctgatattctggaattcttttttttttttttttttttttttttttgaggattttgtgtggctaatgtgttctagaagcagagactccagggagaaccagaatttatgaagcctcgtgcaacatggtgctttctcaccgaggtcatatgcctggctgctgctgttccactcagctccatga

SEQ ID NO: 118786 - DNA, 1204 bp, Homo sapiens
  Payload ID: 3258
  Gene Symbol: C2orf68
  Gene Name: chromosome 2 open reading frame 68
  ENST ID: ENST00000420686
  CDS Start-End: 1-128
ggcggctggacatgaaccacggcttcgtgcaccatatccgacggaaccagatcgctcggtaccgccccgccctgcgccgccgccgccaccactcctggcctggcctggcccggcccgacagtccctgactcccgctcggctccccgcagggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcagtcattctttcttatatgttgacccatttgcccagcctgatattctggaattcttttttttttttttttttttttttttttgaggattttgtgtggctaatgtgttctagaagcagagactccagggagaaccagaatttatgaagcctcgtgcaacatggtgctttctcaccgaggtcatatgcctggctgctgctgttccactcagctccatgagccacgtttgttattttatgtttcttctgtgcttttgctcatttccacccatgtgtttatagaccttttttcagccctttttctttgttcctttccctcatctttttgcctcaggtagaatccatcagttttcctccccctccaaatgactgtgtacctccagctgctcaggactttggaggtgggggcggggcctggggatctacccttctaaaaaactctccaagtaattctgataccaataaagtgggagacctccatttttgaggcctatttgcaagca

SEQ ID NO: 118787 - DNA, 3728 bp, Homo sapiens
  Payload ID: 3259
  Gene Symbol: C2orf69
  Gene Name: chromosome 2 open reading frame 69
  Uniprot ID: Q8N8R5
  ENST ID: ENST00000319974
  CDS Start-End: 184-1341
cttcctttccttacgcacgctgcgcgcggacgtcggcctctgacgtcgtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaagacactgaagcttaataccttaatgacccagaagacctagatttataaagccatatagaataaaaatgttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggctttttttttttttttaaagacaaagtagtattatgttgcttcagtttctttaaatacctcgtttcttttgagaccaaaaattcccatcaaggaaataaatcagcctgattttaacattttacatattacattgcctttaagcactatgattggatggctttttttctatttgtttaataatccttggctaaattcacatgtatctaaaggaaaatagctgagttactgaattctataaggggaagaaaaagcatttattttcacatgattaactgaaatggaaaagtaagacatttagcagaataattcatttaaaaataattttaaaaaatcagacatatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccacatttgtttaaaacttattgtaatgttaatttacacttttggattgtgcctttgtcatgagttgagaaaagtagtcctacaaataatgtgaaagttgttaccaccacagcatgaatgtataattgtattaaaattgatcatccacagaa

SEQ ID NO: 118788 - DNA, 731 bp, Homo sapiens
  Payload ID: 3260
  Gene Symbol: C2orf70
  Gene Name: chromosome 2 open reading frame 70
  Uniprot ID: A6NJV1
  ENST ID: ENST00000329615
  CDS Start-End: 32-637
gcgccaggctcgctgtactcgcgcacccaccatggcctcccgcagcgcgggcaccctactgaccgagttcaatgccgcctacgtgccccctggactcatgcccgggtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaccatgcta

SEQ ID NO: 118789 - DNA, 764 bp, Homo sapiens
  Payload ID: 3260
  Gene Symbol: C2orf70
  Gene Name: chromosome 2 open reading frame 70
  ENST ID: ENST00000409392
  CDS Start-End: 103-657
ccaggctcgctgtactcgcgcacccaccatggcctcccgcagcgcgggcaccctactgaccgagttcaatgccgcctacgtgccccctggactcatgcccggatgccatgggttgactctgatttaaagagattcttagtaccagggccacgtccccactgtggccttctcctttggcgctccctacggcaccaccaccctcaagtacttccaggaccaccgcaacagagccatggagaagagccacactcccttcagccaaggcggccatttccccaccatcttctccaccaaccccaacctcctgctgatggagcgcgccagcacccgggaccgctggctgcacaagcccagctacactcgcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatgaccatgcta

SEQ ID NO: 118790 - DNA, 471 bp, Homo sapiens
  Payload ID: 3260
  Gene Symbol: C2orf70
  Gene Name: chromosome 2 open reading frame 70
  ENST ID: ENST00000453368
  CDS Start-End: 1-385
gcttcaacctggacagccatcgctccacagagcttacgaatttctaccagatggtccagcagcatcggaagtactatcaagacaagacgggcacagtgcctcgagtcccctactttgcgatgcccgtgagggagccggaacggtaccccctccccaccgtcctgttgcctggccacttgcactgctgctgacagtttcacaacgaacgcaaagggccaaccaggtggttgggagaagagggcctcctctgtgcccaaagaagaagtggcaccttttaagactagcccccgagaacctgaagacctaccagaccttcccatcagggaagagggtctctccacaggagcggaaaaagagagactgctactttgagttcagagcatgagacttttagttcagagcagagcctgatgcctgagatcctgggtcgtgaccagcctggcttgcttggaataaaatctttagccatga

SEQ ID NO: 118791 - DNA, 7044 bp, Homo sapiens
  Payload ID: 3261
  Gene Symbol: C2orf71
  Gene Name: chromosome 2 open reading frame 71
  Uniprot ID: A6NGG8
  ENST ID: ENST00000331664
  CDS Start-End: 1-3867
atggggtgtacaccttcacacagtgaccttgtaaacagcgttgcaaagagtggcattcagttcttgaaaaagcccaaagcaattcggccaggatgtcagggcggaagtgaaagaggttccatccctttgctggttaaaaactccacctgctatgacgctggggagggcctggcagaggagcagccaagtcccaggaggaaccaaaccacagctaaaggtctttgtcagctcatgggagatcctgcttcaggcaaaaggaaagatatggaaggactgatcccaggaaccaaaacctcttcatcccagctgaacaaatcacaaagccacatggctaaggatattccgttcaagacacagggttcccatggatcacaaggggcagacttttctggagatgagagtgaggaaagtagtacccaagatacttccaaatggaaaaggacagcaaaatgtcacacgtcaagcacacagagccactgctaccaaaccatccaccctgctcatgagcctgaaggcaaagtggacttcccggagcctctggtaaaggcccaccagcaggcttacacctatctacactccagcctctccaaatatgaagcaattctgtgcatcatccatcaggccacccagacccgggagctgctgcagcccatggtcagcttcttgctgctgtgctttgaggagatcagccagctgttgggggagatctccaaggatggagaagtgctcctgcaggaagtcagggaggatctggcttggcctttgaagaaaagagagccccaggagcagccaaatctcctgcaacagctgctacagtacacagtcagcaagctgcaggtgctcaatggcacagtggcctcgctcaccggcagcttcctggagggctccagcagctacctccactccactgcaacccacttggaaaataagctgagcacaaaaaggaatgtggatgaacgcctcctgagggctctgaggcagctagagagcctggcgagtggctgtggcgaccctggggtgcagggtctccccttatgctctgaggacagtggcattggtgctgacaatgagtccgtgcagtcggtggacaagctgggcaagcaaaccagctgggaccttgcaccagagcccgaagaatggaagtcggtgacttcaccccacacagaggccaggcagtcaggacacacctggcagcaaagtccattctgtttgggctcaggcagaccccaggactgcctgctctcaggggctcctatggcaaaggttcagccacgagcacaggacgaagcaaggagcccatgcctctccagtacaagcccagaaaatatcacctccccacctttgaagctggggacaagcaccccatgtgattcctttgggattggggtctctgtggaaccacacctttccaaaacctccaggccgatggacgcttcatctcttagtgacagcgaggacagcagcccagaggaggaggaggaagacaaaatgagcagcatgagtctgtgtgcctggcaggaaaaaactccacattcaaggccacaatcttcacctgctgaccgggaaagcccatttcaggcccgcaccaggaggcttaggagcctccaggcccaggaaatgattctgaagatgaaggagtcaatcagcgaaaggatcaagtttgtccctgtgccctgtgggcaccaggactggtctgaggaggaggaggggaggacagtggtccccccaagacctagcacggtaagtggcagcaggagggcccctgagaggcagacgaggtcccagtcagagtcgtgtctccagagtcacgtggaggaccccacctttcaggagctgcgaagggtccagagggacctcagtcagaagctggaggcattttatgccctgggtgccaaagggcaggggcagagccaggagcaaattctgcagcccagagcagccgccgtgtggcccaatggcacctgcagggtcagtccaagcaacaccaccagcaggctcaaggcatccctcaccaagaacttcagtattttgcctagtcaggacaagagcatcttgcagaaatgcaatccccatcctgaggacgaacaaggcaaagctgggaagcttccaaatgccatcccatcaggagaggtcagtgaggctgccaaggccacagactggaatgtcagaggctgtcccaccagaacatccgtcaagaagcttattgaaactttcagtcccacggagagtctgaggatgctgggggactctaaggacgctggggcaagtccctgcctcaggaattgcatcatgccccccagatttcccaagtacacagggcttgcccctttgtatccgaagccccaaatttctccagcatcaggcagagaatctctcaaaatgggcataggctggaagcccttagcacctatctttccccctctgcctaaagcagaagcagccaagagtgaggagctcagctgtgaaatggaggggaacctcgagcacctccctccaccgcctatggaagttctgatggacaaatcattcgcttctctggagtccccagaaagcagcaagtccacagagaactcccccaaggaaacccaggagccagggccgggagaggctggccccaccaggagaacatgggcttccccaaagctgagggcctctgtgagccccctggacttgctgcccagcaagagcaccgccagcctgaccaagcctcacagcacagggccagggagtggcaggagcagctgccagcccaggaagccagccctggacctgagcagcccaccagccaccagccaaagccccgaggtgaagggtgggacttggagtcaggcagagaaggccaccagcctctacaggcagccccggaaggccatcgcctggcaccactccggccctccatctggacaaaacaggacctcagagtccagcctggccagaccaaggcagagccgagagagaagcccccctgtgggcagaaaggcctctcccacgaggacacactgggtgcctcaagcagacaagaggcgccggagccttccctcctcttacagacctgcccagccaagcccctctgctgtgcagacgccccccagcccacctgtgagccccagggtgctaagcccacccaccacaaagcggcgaacttccccaccgcaccagcccaagttgcccaaccctccccccgagagtgcacctgctcagtgcaaggtccccagccccccaacccagcacccagaagcaagcccccctttctcgattccctccccatcacccccaatgtccccttctcaggagcacaaggaaacaagagactctgaagacagccaagcagtcatagccaaagtgtctgggaacacacattccatattctgcccagctacctcctctctgtttgaagctaaaccgccactctcaacagcccacccactgaccccaccatcgctgccgccagaggctgggggccctctcgggaacccagcagaatgctggaagaacagctcagggccttggctgagagcagactcgcagcggagagcagctctgtgtgccctcaaccctctgcctttcctcaggaggacagcttctgaccgccagccaggtggccgaccgcagcctcccaccttggaccccaccagcacctcttatgaatcccagctcggccagaacagcagcagcgaggagagccctaagaaggacacagagccggggagcagcccctgttcccctgaactgcagggcggcaccaggcgtgcatctcccccagagttctgtgtgctgggccacgggctgcaaccggagcctcggaccggccacatccaggacaaatcccagccagaggcgcagccccagcaagaggaggtgtcctgacaggctgacgagggggccacactcacgcagtcaccccagaaggccaagtgtgacagccaagtgtccagcctgacccagagatgatgggcaaaccaaactcctactgaggtgtcctggaaaggcctggaaggtgcactgcccagtgggtctgctgaattttaaacaatcgccgttttcagtcccagatcttgctctgccttggggttcaaaggttaaccagaacttttagaccccacaatgacagtatttaatgcttcaagtgctggccttaatttggggtggggtggggggtggagaatgtatagttgcatgcttgatagggttttaactgggttcattccttgagatcacttaagcctcacaacagtgaatgaagcacatagcattcttcagttttgcgcatatgaaaaccgaaggtgtggggagaggccccctcaagtgtctggctgaaggtcatacagctaagaagagaatagagcaaaattttgcacagatgagtctggtgttagaatctctctgctctttttattacattccattgcccgtaactattgcgtcactccacctgcctaaagcagacatgggtgcgcaaatggtcgcaaagcttctttgttgtaaggttaagtagcggcacagcattgacaaagtccctattgagagctttgtttagaagtgcatggctcccaaaatgagaaggctgagtgagccaggattaaaacacacagccccacccgtcctctgtcctctcctccttcccaagctcagtttcaatgctgtaaacttaaagctgacagctcacaataccagccacgctgcctctcggcctaagcatgtagcaaatgctctcactgccctacgcattacatgcttctcgacggagtagggtaaaccaagcctcccaaacaaggcagcccattctccacatgccgtgggtgctggagctcagaagatagcgtgggtgaggcatacgtactcacacgccgatctcccctcggaggcttcttggccaactttattcccaggtcatcttgcagaacttctgctggagtcgaaatcaaagtgaaaaacagttgttcatgccaaaaacctgcttctgccaatgagctagatatttgctgcagatcttggaatgcttccactggaggctgtggtgtgcgttctatttagaaaagattttgcagtaattgagtgattcaatgccggctcaatgggttggcaaaagacaagaattcttacccactggggtacagcaaagggacgatcctccagatctgctgcaaagctgatttttaaagtttggggtaattatagacctcaaacccattcttgctgggactgtgggctcaaaaacttgttaaactgggtccctagggactatagcaacctcccccagagagaggctatgactctgagtaaatgaatcccaccttgacttgtccaattattattcaaaggcacccaaagaacagctgattaaactaccaagaggggccacaacccacccctctgctggaaagggacacacccagctgtctgctcgcatttgctcctgttgccgccctcatctcagagaagtgctcaggcagtgcccaggccagccgattctagagccaagccacacccactgctgggtggacacttaggagctgcctggactgcaggcaacgcagggaagtccagccacccaggcagggcaggggccaaggtaagcacgtgaggatggaccaggttcagcaaacttgcccgacagagatctgggcattctccctaaatggttgggcagaccaaccattgggtcaccatggggtgagccttaggtaagctgggcactgagctgagtgagcaggagacacacagtgtgagcggcctttgaggtctagctcacaagtaagtggcttcaggtgggactgctcagaaagtgggccctgcctgggctcagatttaggggcaggattcctggaggtccgaggaaacgaagctgttccccagctgcagggagactggagtgggacacagtgggtgaaactggggtaccatgaggggtggaaccccaggaattatacacattttcattactggaaccgggatatgaagtggagccactccagcagtgaggggaagcaaggctgagtctccagcccaggcctccttccgtaaagggcctcatcttaaaagtccagggctgggtagaaagtggaaagggtggccgagtgccccctgctgtggccatgcaagctagcggcagcagggagccaggcagattattccaccacagaaggggtcagtatcatggagaacacgcaggaagggtccggaatgaacaacggtgctttccgtgagcatgcatggcaggaggctgtctgagactagaggttgtccctcgccaggctaggctggcaagcagcaggaagtgcccacccaccatattgcaggcagcagacgaaggggtacagggcacccgggatcctgccatcagctgtggagatgcccatgatgcctccttgtccctctggaggacctccacgtttgcttggggccaacgtgtgccaggacagggcgaggctcctgccataggtccccacacacgatgtcataaaagcccccagctgccaccagacccaggcagccgggacagtgagctggtgacaccattgtgttgcccagtaaccttaggctactggaattccaagtcagcttcccccactccagggaagatggggaggggttgccaaggtgctgggggctgggggtcaattaggtcaaaggtgaagcagtgctgagccgacataggagcaggcgggtcaaagatgtgtttttggctaccataccaactaccagacttagctcaaattacatgtgaattagactttgtacaaaaggaattaaatccacaatggaacagttttgtggcatctggtcagttttgcctcctagagaccaggtcttccacaaacttgagtctgccttggagcacgcattgctggtggcaggaggggcaaacccagctgtacagcttctcagacaagggctgctcacgcccaccatctcccttctacccaagaatggtatccttgctgggccaaatccacttcctttgcccaagggggaagggaggacagtttttctttgttctgctttttgttttaataaaaattattaagccaatgaacccaactc

SEQ ID NO: 118792 - DNA, 3657 bp, Homo sapiens
  Payload ID: 3262
  Gene Symbol: C2orf72
  Gene Name: chromosome 2 open reading frame 72
  Uniprot ID: A6NCS6
  ENST ID: ENST00000373640
  CDS Start-End: 77-964
gggcgccaccgccccgagaggcgggcagcgggtgcgcccgggccgcggcggccgcagagggcgggcggcggccagcatggagcgcgagctggaggcgctggcggcccggcttgcgcgccctgccgagccgcccttccaggcgttggtggaagcggcggggggccgcgggcaggtgctgctggtgggcgagctgtgggagcgcgaacagagccgcgcgctgctgcgggacttcgcacgggcggtgttcccgccggagccaggcgcggccaagccgggcggcgcggcggcagagggcgcggggcccggggcggcgcgcggggcgcagagggcggcgagggcggctggggcggcgggggcggcggcggcggcggcgcgcgccatccgctcgccgctggtcttcgtgctgtgccgcgcgtcgtcgctggccgcccgggagccgcggcgccgcctgcgggagatgctgcgggacgtgcgcggccggcggcgggccggggcggcgctggtcggggtgctggtggccgaggccgggccagaggacgcggtggcgccggggctgcggctgctggaggcgctgttgcgcgccgtgttcggccgccaggcgggggggcccgtgcaggcggccgcctactgccccggcctcccggcctcctgcctggccgtccaggcggccgcctgcagggccctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaa

SEQ ID NO: 118793 - DNA, 1713 bp, Homo sapiens
  Payload ID: 3263
  Gene Symbol: C2orf73
  Gene Name: chromosome 2 open reading frame 73
  ENST ID: ENST00000317627
  CDS Start-End: 43-222
tcttcccaggaggctcctcgctgcctggtgccgtagaggcccatggaggaaaaggaagataagcatcaggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 118794 - DNA, 1921 bp, Homo sapiens
  Payload ID: 3263
  Gene Symbol: C2orf73
  Gene Name: chromosome 2 open reading frame 73
  Uniprot ID: Q8N5S3
  ENST ID: ENST00000398634
  CDS Start-End: 43-906
tcttcccaggaggctcctcgctgcctggtgccgtagaggcccatggaggaaaaggaagataagcatcaacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgc

SEQ ID NO: 118795 - DNA, 576 bp, Homo sapiens
  Payload ID: 3263
  Gene Symbol: C2orf73
  Gene Name: chromosome 2 open reading frame 73
  ENST ID: ENST00000405749
  CDS Start-End: 75-416
gcacccttttcctggcagggctgcgtccctgttcttcccaggaggctcctcgctgcctggtgccgtagaggcccatggaggaaaaggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagatgaaaccttgagaaaaggagccaagactgtaacagtggtcctgtgccacagtgcaggaagaaaaggaacagagagatcacgggcatgtttttttaggtggtttcatgccatcttattttctccttgaaatacattcacaatgaggtgactggctctgtgggaagcctatggccatgttgtaatgacactcaatcagcccagtggagagggccacatggcaaggaactaaggcctcccaccaacagccagcaaagaactgagaccttctgcctacagtcatgagtcct

SEQ ID NO: 118796 - DNA, 656 bp, Homo sapiens
  Payload ID: 3263
  Gene Symbol: C2orf73
  Gene Name: chromosome 2 open reading frame 73
  ENST ID: ENST00000447328
  CDS Start-End: 22-656
tgcctggtgccgtagaggcccatggaggaaaaggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggaga

SEQ ID NO: 118797 - DNA, 560 bp, Homo sapiens
  Payload ID: 3263
  Gene Symbol: C2orf73
  Gene Name: chromosome 2 open reading frame 73
  ENST ID: ENST00000414747
  CDS Start-End: 1-247
ggaagataagcatcaacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagagacacggagcttttgtacagagagagataaaaccaggcagtaggccaacagttcctaaaggagcagagatgaaaccttgagaaaaggagccaagactgtaacagtggtcctgtgccacagtgcaggaagaaaaggaacagagagatcacgggcatgtttttttaggtggtttcatgccatcttattttctccttgaaatacattcacaatgaggtgactggctctgtgggaagcctatggccatgttgtaatgacactcaatcagcccagtggagagggccacatggcaaggaactaaggcctcccaccaacagccagcaaagaactgagaccttctgcctacagtcatgagtcct

SEQ ID NO: 118798 - DNA, 802 bp, Homo sapiens
  Payload ID: 3263
  Gene Symbol: C2orf73
  Gene Name: chromosome 2 open reading frame 73
  ENST ID: ENST00000486488
  CDS Start-End: 133-802
ggacttttctttttccgttatccagggaaatgcgtgagttactatgacagatgccaaagacttttggctctggtagtggaaattgggaggcaatggtgaaatgaagtaagaaattccagggccagaaggtggatgcaagtcagcaacggcttttcccaggagcttgctctttttggacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaa

SEQ ID NO: 118799 - DNA, 1376 bp, Homo sapiens
  Payload ID: 3263
  Gene Symbol: C2orf73
  Gene Name: chromosome 2 open reading frame 73
  ENST ID: ENST00000615983
  CDS Start-End: 339-551
cgtagaggcccatggaggaaaaggaagataagcatcaggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcctgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttggcttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgcca

SEQ ID NO: 118800 - DNA, 565 bp, Homo sapiens
  Payload ID: 3264
  Gene Symbol: C2orf74
  Gene Name: chromosome 2 open reading frame 74
  ENST ID: ENST00000398622
  CDS Start-End: 83-241
ttgacgtcgtccgagagtcttaaaatcctgctctggccggattccagactcgtgggggaaaggctggatttcaacagatcacatggatcaaggccttagggaggtggttggggattcacgtatgccctggaccatctggagcccaagttgctgcagatcctgtcaccacgagtggacaccctctggccaccatagcaaagaagtctgcaggcaggagatggagtctcgctctgttgcctaggctggagtgcagtggcacgatctcagctcactgcaacctctgccttcccagttcaagcaattctcctgcctcagcctcccaggtagctgggattacagtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggag

SEQ ID NO: 118801 - DNA, 879 bp, Homo sapiens
  Payload ID: 3264
  Gene Symbol: C2orf74
  Gene Name: chromosome 2 open reading frame 74
  ENST ID: ENST00000426997
  CDS Start-End: 251-598
gcacacagatgttagggttcgggcgagctatttggagcctgcgcagtcagatccgaggacatgttgacgtcgtccgagagtcttaaaatcctgctctggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaa

SEQ ID NO: 118802 - DNA, 887 bp, Homo sapiens
  Payload ID: 3264
  Gene Symbol: C2orf74
  Gene Name: chromosome 2 open reading frame 74
  Uniprot ID: A8MZ97
  ENST ID: ENST00000432605
  CDS Start-End: 1-585
atgagtcttctagctaaacctatgagctttgaaaccacagcaatcactttcttcatcatccttctaatttgcctcatttgcatcctcctcttattggtggtttttttatataaatgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtacaaat

SEQ ID NO: 118803 - DNA, 423 bp, Homo sapiens
  Payload ID: 3264
  Gene Symbol: C2orf74
  Gene Name: chromosome 2 open reading frame 74
  ENST ID: ENST00000489686
  CDS Start-End: 340-423
gttgacgtcgtccgagagtcttaaaatcctgctctggccggattccagactcgtgggggaaaggctggatttcaacagatcacatggatcaaggccttagggaggtggttggggattcacgtatgccctggaccatctggagcccaagttgctgcagatcctgtcaccacgagtggacaccctctggccaccatagcaaagaagtctgcaggcaggagtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacaccctta

SEQ ID NO: 118804 - DNA, 726 bp, Homo sapiens
  Payload ID: 3264
  Gene Symbol: C2orf74
  Gene Name: chromosome 2 open reading frame 74
  ENST ID: ENST00000464909
  CDS Start-End: 97-444
gcgcagtcagatccgaggacatgttgacgtcgtccgagagtcttaaaatcctgctctggccggattccagactcgtgggggaaaggctggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaag

SEQ ID NO: 118805 - DNA, 1070 bp, Homo sapiens
  Payload ID: 3264
  Gene Symbol: C2orf74
  Gene Name: chromosome 2 open reading frame 74
  ENST ID: ENST00000488469
  CDS Start-End: 209-772
tcctctctcctctgggtcctgatagtttttggggtgagggaggtgagctgcgtgatcacacatgtcccagctcagtctcccctctggccacctcagcccccaccacagttatggagagaaattagccagtaaaacttaaagaacaagagaactgcattcaaattgagctggaaaagaatatttggacagtctgtgattgtgagagtggatgagtcttctagctaaacctatgagctttgaaaccacagcaatcactttcttcatcatccttctaatttgcctcatttgcatcctcctcttattggtggtttttttatataaatgtttccaaggcaggaaaggtaaagagacaaagaaagtgccttgtacagatgcaaacggaggtgtagactgtgcagctgccaaagtggtgacaagcaatccagaggaccatgaaaggcgagtgtggtgcaggatgcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtac

SEQ ID NO: 118806 - DNA, 676 bp, Homo sapiens
  Payload ID: 3265
  Gene Symbol: C2orf76
  Gene Name: chromosome 2 open reading frame 76
  Uniprot ID: Q3KRA6
  ENST ID: ENST00000334816
  CDS Start-End: 52-432
gcaaacgccgggagtagccgaaggggacgccgggaacaggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcatacctgtattaagctctttattccactgctgaatttttgaaattgacaaacaaatcttaaaaaattaatcccaggctatactctttgagctaaaatctggttatttctttctcttcaggtctttccttctctctttctttttctttgttgttgtaaaataatatattatgagaaaaacatttgatctttttaaagggaaataaattgttattaaaaa

SEQ ID NO: 118807 - DNA, 1150 bp, Homo sapiens
  Payload ID: 3265
  Gene Symbol: C2orf76
  Gene Name: chromosome 2 open reading frame 76
  Uniprot ID: Q3KRA6
  ENST ID: ENST00000409466
  CDS Start-End: 523-903
tcgagagttgggttcagtcctggcccgttgtggggacggcacgcgggggaaggggaggggacggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttgggccagctgaggggcccacggacatagggcacccacaataggcgtgtgtctgctgtgtgtttgtgttcggccgtcctgcttctctgtttccacacgtacacatgcccctgtgttactttggttcatcttctgtactctgtcagttttctgctggtcagaacatctgtgactgtgacagagctgtccaggattgcagtggataggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcatacctgtattaagctctttattccactgctgaatttttgaaattgacaaacaaatcttaaaaaattaatcccaggctatactctttgagctaaaatctggttatttctttctcttcaggtctttccttctctctttctttttctttgttgttgtaaaataatatattatgagaaaaacatttgatctttttaaagggaaataaattgttattaaaaatta

SEQ ID NO: 118808 - DNA, 747 bp, Homo sapiens
  Payload ID: 3265
  Gene Symbol: C2orf76
  Gene Name: chromosome 2 open reading frame 76
  Uniprot ID: Q3KRA6
  ENST ID: ENST00000409523
  CDS Start-End: 339-719
acggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggcacgttctttgacttgcttgtggccgtagtgtcaggcctgtattgcacatttatgtctgtggtgcatttctccatctggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcat

SEQ ID NO: 118809 - DNA, 950 bp, Homo sapiens
  Payload ID: 3265
  Gene Symbol: C2orf76
  Gene Name: chromosome 2 open reading frame 76
  Uniprot ID: Q3KRA6
  ENST ID: ENST00000409877
  CDS Start-End: 542-922
acggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggcacgttctttgacttgcttgtggccgtagtgtcaggcctgtattgcacatttatgtctgtggtgcatttctccatctgggccagctgaggggcccacggacatagggcacccacaataggcgtgtgtctgctgtgtgtttgtgttcggccgtcctgcttctctgtttccacacgtacacatgcccctgtgttactttggttcatcttctgtactctgtcagttttctgctggtcagaacatctgtgactgtgacagagctgtccaggattgcagtggataggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattcagaaattataaatatgatgcactaaagattattcatcaagcacataaatcaaagacaaatgaacttgtgttgagtttggaagatgacgaaagactcctgctgaaagaagacagcactctgaaagcagctggaatcgccagtgaaactgaaattgcattcttctgtgaagaagattataagaactacaaagctaatcccatttcatcctggtgaaaacatctcgagggcttcctttttgcat

SEQ ID NO: 118810 - DNA, 509 bp, Homo sapiens
  Payload ID: 3265
  Gene Symbol: C2orf76
  Gene Name: chromosome 2 open reading frame 76
  ENST ID: ENST00000414534
  CDS Start-End: 254-509
agttttgctgccgggagttggtcgagagttgggttcagtcctggcccgttgtggggacggcacgcgggggaaggggaggggacggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggaatttcttcacatggctcctggagaagtgaccatcacagttcgcctcatccgttcctttgaacatcgcaatttcaaacctgtagtgtatcacggagtgaatttggaccaaactgtaaaggaatttatcgtatttctaaagcaagatatccctttaaggaccaacctgccaccaccattca

SEQ ID NO: 118811 - DNA, 3045 bp, Homo sapiens
  Payload ID: 3266
  Gene Symbol: C2orf78
  Gene Name: chromosome 2 open reading frame 78
  Uniprot ID: A6NCI8
  ENST ID: ENST00000409561
  CDS Start-End: 122-2890
ccaccaaaccgaccaccacctggtagcatcttggggtttcctgggcgtggcctgtaaatttgtatcatcacaaggggccagtgaccagtaaccagtgaccagtggccttcatactggacacatgcactggttggcttcagccacccagacatccgctagtatcgtctcttcttcccttctatctgcagttgatgtttcttcttctctgaccatgtcagaatatttccaaaatacgtctttacctggaactgcaaattctcggcagttctctcttcctgtggtgagcaatgcagctttcttaacaggaagcatctccaacttctccagagcctctgctccagccatcagctcagcatggctacagccatcagcctctggcacctccttccagccactcatgggcagtgcctacctttaccaacattctagcacaactatgttgtctggggttactggccagagccatatctgtacttcagctgcctcttatccaggcgtttttgagtgggatagtacagcaagcacagtaaagaagtcatcctcactcagggacttcactgtgactgtcattgatcagaacacagctgtctcttccatgtctatgacagcccagtattataaaacttcagataccaatactatggtccctctgtatccatcactatctgccagccttgttcaggggacactaactcaaattccaaatcagcagggccataacctgtcacttccctgccagataggaagccaggtctattactataatcaaggcacactggggcctcaactatcctgcctgcaatcttatggctctgtgtcatacacaggatatagggcttctgcccatcaaccagaaatggtgatggtgctgaaggaggttcagcccacaaatgtcctaccaccagtctctacttctgggatgtattactctgtgtcttctcaacccatcacagaaaccagtgttcaagtgatggaaacttccctggggatggatacttccctgggattgcaatctccaagccagacattttgtctgccacaaactccagaattctccaagtccttcagtagcagaaatacccagacacttgagagtaacccatcacctgagcttggggacatttcaataactccagtccagagtcctactaatctcttgacactgtctccagctccaagccaggaaaaaaatgagaatgagaatttggatgagattaaaaccaacctttcaaagcctctagatgtccaccagatcctaataggaaatcaagatcctccactacttcctgtagaaatccccgatattcacccgcttctggcctgcattgatcctcttggccaagaggagcagcctggttctgaaaatgccaatctaagaaataagagcctgagtcttgaggaccaagggatatttgaaaatgggattgagtctagcagtgatttggcagacatcactacatgggtggaggatacttacctccccccgatcttcagttccttacaagatcttgaccaacctgaaagtccctcagcaaagaaagccaaagataccagtgccatcaaggtaaatcaggtgcaggaaaagtcatgtgtcataaagggtcactctgatcaagtcaggaagaacaagcataaagcttccgagcctatccagggtgctcccaaggccaaaatccagccaaagaacccagagtgcctattagagagagaagtggttgttggcagtgctacagtcagtaacagcgcttctgtgaacaaggccaagcattctagcaacaaacctcacaaggctgcatccagcaggatcagcaaaactaagagccatgggcaggaaaagaccaaagggaacagaaagaacagctccaagaaatctgaagagagtaagcagtcagggaaaaaagtcaaggtagaagagaagcaaaccattcccaatatgaaacggaagaaaaatcaacctgagcttagccaaaagacccttaaaaagccccgaagctccctaggcatgcacatgctagagtccgtgcaagttttccatgcactcgggaaaaagatcgatatgaaaactggattctcttcctccaggaccctgggaagctcaagcaacacccaaaaccgccagccattcccagctctcaaaccatggctggatatccaacatgagggtaaaggcccggagaaaattcaagtcaaggcccagaaactagatggtagtgctgaaaaagagtgtacatctccatcccactctgagttgccaccacctgggaaggtcaagttgatacctttgccctttctgaccctggaccaacctcaagctcgacatgtttctcggcggccaaaccctctagcctcacgtaggcctgctgtggcttaccctgctcgacctgattctactaactcagctcaatcgaatgcagtcaatccatcccgaccagctcctaccaacacatctttgacaggtcctgccacaccagctcagccaatttcagccaaagcaacccaacccagttcagccaaccctacccagcctactgtccctcaatctgctgcttctaggccatcagcctacaaaacatcatcttgttcttctctgcagcgggagcctgtttccactgctgtgaccagtctccggtcactgcccaagcctcaaaatcaatttctaatccaagacttcagcctccaaccccgtccatggaggaaacccactgttcctgagccagtaatgtcaacgcccatcacagaagagcagaggccagagcgtgaggccatgaagagaaaggctcaacaagagcgtgagaatgctgccaaatacacctctttggggaaagtgcagtttttcattgaaagggaaagagatatggaaattgctgaatactatggctacacaatctaagagctgagattgttggttttactttggataccgctggttttccacatatatagatagatactaatttatttattctgatatatttttaaaacataataaagaaatgtaatagaattgattaatagataagtaataaagaggccttttgagttttg

SEQ ID NO: 118812 - DNA, 1238 bp, Homo sapiens
  Payload ID: 3267
  Gene Symbol: C2orf80
  Gene Name: chromosome 2 open reading frame 80
  Uniprot ID: Q0P641
  ENST ID: ENST00000341287
  CDS Start-End: 197-778
agcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaa

SEQ ID NO: 118813 - DNA, 816 bp, Homo sapiens
  Payload ID: 3267
  Gene Symbol: C2orf80
  Gene Name: chromosome 2 open reading frame 80
  ENST ID: ENST00000451342
  CDS Start-End: 1-420
agacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagatagagacggggtttcaccgtggtctcgatctcctgacctcgcgatctgcccgccttggcctcccaaagcgctgggattacaggcttgagccaccgcgcccggcccaactcttgggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaataca

SEQ ID NO: 118814 - DNA, 722 bp, Homo sapiens
  Payload ID: 3267
  Gene Symbol: C2orf80
  Gene Name: chromosome 2 open reading frame 80
  ENST ID: ENST00000453017
  CDS Start-End: 19-393
gctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcac

SEQ ID NO: 118815 - DNA, 386 bp, Homo sapiens
  Payload ID: 3267
  Gene Symbol: C2orf80
  Gene Name: chromosome 2 open reading frame 80
  ENST ID: ENST00000449053
  CDS Start-End: 188-386
aagaacaaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtggg

SEQ ID NO: 118816 - DNA, 979 bp, Homo sapiens
  Payload ID: 3267
  Gene Symbol: C2orf80
  Gene Name: chromosome 2 open reading frame 80
  ENST ID: ENST00000451346
  CDS Start-End: 3-527
agatgcgcggatgcttcagcatgcctccagaagcagagaaagaacaaaagcactggaaccggtctccggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaa

SEQ ID NO: 118817 - DNA, 748 bp, Homo sapiens
  Payload ID: 3267
  Gene Symbol: C2orf80
  Gene Name: chromosome 2 open reading frame 80
  ENST ID: ENST00000428015
  CDS Start-End: 1-385
tgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaa

SEQ ID NO: 118818 - DNA, 460 bp, Homo sapiens
  Payload ID: 3267
  Gene Symbol: C2orf80
  Gene Name: chromosome 2 open reading frame 80
  ENST ID: ENST00000423952
  CDS Start-End: 210-460
gatacctgctcagctggctaagcctttaacatggaaagaaggctcataaagaaggaaatgaaaaagctcttgcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaagga

SEQ ID NO: 118819 - DNA, 2227 bp, Homo sapiens
  Payload ID: 3268
  Gene Symbol: C2orf81
  Gene Name: chromosome 2 open reading frame 81
  ENST ID: ENST00000290390
  CDS Start-End: 310-2076
gagggttcccctggtcttaaaaggggcccaagcccccattctggcacaccccactccactgtcctggcagcagcaggtgtggccaatggaggggggtgctggcccccaggattcccccagccaaactgtctttgtcaccacgtgaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagtacatattgcagtgatggagatgcagtcacctattgtccagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcctgccgacgatgccgacccttctctggatccgtacctggtagccagcccccaggcctcaactgggaggggacaccccctcggcttccatttgtcgttggaagacctctactgttgcatgcctcaactggacgcggctggggatcggctggaactcaggtcagagggggtgccctgcatcgcctcgggcgtgttggtgtcctacccctctgtgggcggcgccacccgcccctccgcgtcctgccagcagcagcgggccgggcactcggatgtgcggctgagcgcccaccaccacaggatgcgccgcaaggcggccgtgaaacgcctggaccctgcgaggctcccgtgccactgggtgcgccctctggctgaggtcctggtcccagactctcaaacacgccccttggaagcctaccgcggacgccagcggggcgagaagaccaaggcccgggccgaaccccaagccctcggccccggcacccgtgtctccccggcagcgttcttccctctccggccaggcattcctttccgtgacttggactcgggccccgcactcctgttccccactttaaatttaggcctatcgtcgccatccctcgagtcaaagctgccactcccaaactccaggatccgcttcctcaccacacacccggtgctccctgatgtggcccgcagccgcagccccaagctgtggcccagtgtcaggtggcccagcggttgggaggggaaggccgagctgctgggcgagctgtgggctggccggacccgcgtgcctccacagggtctggagctggcagacagggagggccaggatcctggcagatggcctcgaaccacacccccggtccttgaagccacttcccaggtgatgtggaagcccgtgttgctgccagaagccctgaagctggcccctggtgtgagcatgtggaaccggagcacccaggtgttgctcagctctggtgtgcctgaacaagaggacaaagaaggtagcacctttcctcccgttgagcaacatcccatccagacaggtgccccaaagcccaggtgaccgtagcacagctaatgaagaactcagcccccaaagtgtggtcacgctcctctaagcctgctgcctccctctgatccctgagcctctggcagtagtaactggtccctccctctgctagccagaaataaacacctgagttgccttaggaact

SEQ ID NO: 118820 - DNA, 883 bp, Homo sapiens
  Payload ID: 3268
  Gene Symbol: C2orf81
  Gene Name: chromosome 2 open reading frame 81
  ENST ID: ENST00000518863
  CDS Start-End: 400-883
aaacaccagcgttgctgcgaccgcgttggcgatggcgcacgaaggctcgaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcaggtgggccgggatccgggtccttcagactcgtctccctctcccgcccctccctgccgacctgagatcctctctcgcctccgcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagtacactcctcaggagcctctccggactcctctgccattgctcctgctctcccctttccgacatctcactgcccgagtgcatttccccaggaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttga

SEQ ID NO: 118821 - DNA, 427 bp, Homo sapiens
  Payload ID: 3268
  Gene Symbol: C2orf81
  Gene Name: chromosome 2 open reading frame 81
  ENST ID: ENST00000518401
  CDS Start-End: 101-427
caccgctgctcccggcaaaccggagcatgcaccgcaggccagcggccgagttcgcccatcccagccatcacttttccaactagtccttagagaagggaagatgagcgagtcgagctcgaagtccagccagcccttggcctccaagcagaaaaaggacggcactgagaagcggggccgtggcaggccgcgcaagcagcctccgaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgact

SEQ ID NO: 118822 - DNA, 898 bp, Homo sapiens
  Payload ID: 3268
  Gene Symbol: C2orf81
  Gene Name: chromosome 2 open reading frame 81
  ENST ID: ENST00000517896
  CDS Start-End: 310-898
gagggttcccctggtcttaaaaggggcccaagcccccattctggcacaccccactccactgtcctggcagcagcaggtgtggccaatggaggggggtgctggcccccaggattcccccagccaaactgtctttgtcaccacgtgaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagtacatattgcagtgatggagatgcagtcacctattgtccagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagtacactcctcaggagcctctccggactcctctgccattgctcctgctctcccctttccgacatctcactgcccgagtgcatttccccaggaccctgggggcgtggaccgga

SEQ ID NO: 118823 - DNA, 2407 bp, Homo sapiens
  Payload ID: 3268
  Gene Symbol: C2orf81
  Gene Name: chromosome 2 open reading frame 81
  ENST ID: ENST00000517883
  CDS Start-End: 693-2255
ttttttttttttttttttgagacgcagtcttgctctgtcgccaggctggggtgcagtggcgcagtctctgctcactgcaacctccatctcccgggttcaagtgactctccttcctcagcctccccacttcagtttctttatctgtcaattgtggttagtgggctgttaatgaaaattattaggtcaaacatctactaagtatctgtcacatagtaggctcttcgtcaattggcccttttccttcccactagacaacttgagaaagcttcctcctagcctatagctactcttccgttccacttcttggtttcctgctctgattgccatgttttgttctcacagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcaggtgggccgggatccgggtccttcagactcgtctccctctcccgcccctccctgccgacctgagatcctctctcgcctccgcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagtacactcctcaggagcctctccggactcctctgccattgctcctgctctcccctttccgacatctcactgcccgagtgcatttccccaggaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcctgccgacgatgccgacccttctctggatccgtacctggtagccagcccccaggcctcaactgggaggggacaccccctcggcttccatttgtcgttggaagacctctactgttgcatgcctcaactggacgcggctggggatcggctggaactcaggtcagagggggtgccctgcatcgcctcgggcgtgttggtgtcctacccctctgtgggcggcgccacccgcccctccgcgtcctgccagcagcagcgggccgggcactcggatgtgcggctgagcgcccaccaccacaggatgcgccgcaaggcggccgtgaaacgcctggaccctgcgaggctcccgtgccactgggtgcgccctctggctgaggtcctggtcccagactctcaaacacgccccttggaagcctaccgcggacgccagcggggcgagaagaccaaggcccgggccgaaccccaagccctcggccccggcacccgtgtctccccggcagcgttcttccctctccggccaggcattcctttccgtgacttggactcgggccccgcactcctgttccccactttaaatttaggcctatcgtcgccatccctcgagtcaaagctgccactcccaaactccaggatccgcttcctcaccacacacccggtgctccctgatgtggcccgcagccgcagccccaagctgtggcccagtgtcaggtggcccagcggttgggaggggaaggccgagctgctgggcgagctgtgggctggccggacccgcgtgcctccacagggtctggagctggcagacagggagggccaggatcctggcagatggcctcgaaccacacccccggtccttgaagccacttcccaggtgatgtggaagcccgtgttgctgccagaagccctgaagctggcccctggtgtgagcatgtggaaccggagcacccaggtgttgctcagctctggtgtgcctgaacaagaggacaaagaaggtagcacctttcctcccgttgagcaacatcccatccagacaggtgccccaaagcccaggtgaccgtagcacagctaatgaagaactcagcccccaaagtgtggtcacgctcctctaagcctgctgcctccctctgatccctgagcctctggcagtagtaactggtccctccctctgctagccagaaataaacacctgagttgccttaggaacta

SEQ ID NO: 118824 - DNA, 1902 bp, Homo sapiens
  Payload ID: 3268
  Gene Symbol: C2orf81
  Gene Name: chromosome 2 open reading frame 81
  ENST ID: ENST00000612891
  CDS Start-End: 1-1749
atggcgcacgaaggctcgaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcctgccgacgatgccgacccttctctggatccgtacctggtagccagcccccaggcctcaactgggaggggacaccccctcggcttccatttgtcgttggaagacctctactgttgcatgcctcaactggacgcggctggggatcggctggaactcaggtcagagggggtgccctgcatcgcctcgggcgtgttggtgtcctacccctctgtgggcggcgccacccgcccctccgcgtcctgccagcagcagcgggccgggcactcggatgtgcggctgagcgcccaccaccacaggatgcgccgcaaggcggccgtgaaacgcctggaccctgcgaggctcccgtgccactgggtgcgccctctggctgaggtcctggtcccagactctcaaacacgccccttggaagcctaccgcggacgccagcggggcgagaagaccaaggcccgggccgaaccccaagccctcggccccggcacccgtgtctccccggcagcgttcttccctctccggccaggcattcctttccgtgacttggactcgggccccgcactcctgttccccactttaaatttaggcctatcgtcgccatccctcgagtcaaagctgccactcccaaactccaggatccgcttcctcaccacacacccggtgctccctgatgtggcccgcagccgcagccccaagctgtggcccagtgtcaggtggcccagcggttgggaggggaaggccgagctgctgggcgagctgtgggctggccggacccgcgtgcctccacagggtctggagctggcagacagggagggccaggatcctggcagatggcctcgaaccacacccccggtccttgaagccacttcccaggtgatgtggaagcccgtgttgctgccagaagccctgaagctggcccctggtgtgagcatgtggaaccggagcacccaggtgttgctcagctctggtgtgcctgaacaagaggacaaagaaggtagcacctttcctcccgttgagcaacatcccatccagacaggtgccccaaagcccaggtgaccgtagcacagctaatgaagaactcagcccccaaagtgtggtcacgctcctctaagcctgctgcctccctctgatccctgagcctctggcagtagtaactggtccctccctctgctagccagaaataaacacctgagttgccttaggaactag

SEQ ID NO: 118825 - DNA, 465 bp, Homo sapiens
  Payload ID: 3269
  Gene Symbol: C2orf82
  Gene Name: chromosome 2 open reading frame 82
  Uniprot ID: Q6UX34
  ENST ID: ENST00000331342
  CDS Start-End: 59-424
gttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggc

SEQ ID NO: 118826 - DNA, 663 bp, Homo sapiens
  Payload ID: 3269
  Gene Symbol: C2orf82
  Gene Name: chromosome 2 open reading frame 82
  Uniprot ID: Q6UX34
  ENST ID: ENST00000409230
  CDS Start-End: 248-613
gagccaggcccagcctggaaatggatgtcataagtgcacaggggtctagggaggcagagagcgaaagaggaaacaggagcgttttaggaaagactagagctgcctgagggtttggatcaaaactgctttaaaagtccttcttcaacaagcactgagcacctactccgggccaggcatggagaacccagagttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcct

SEQ ID NO: 118827 - DNA, 561 bp, Homo sapiens
  Payload ID: 3269
  Gene Symbol: C2orf82
  Gene Name: chromosome 2 open reading frame 82
  Uniprot ID: Q6UX34
  ENST ID: ENST00000409533
  CDS Start-End: 146-511
tcctaagtcagactttgtgcttgctctccctaggaatgctgatacctgattctagttatggatatggaggcaaggagaagttgttaggttaaccagcgcagtcctccgtgcgtcccgcccgccgctgccctcactcccggccaggatggcatcctgtctggccctgcgcatggcgctgctgctggtctccggggttctggcccctgcggtgctcacagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcct

SEQ ID NO: 118828 - DNA, 357 bp, Homo sapiens
  Payload ID: 3269
  Gene Symbol: C2orf82
  Gene Name: chromosome 2 open reading frame 82
  ENST ID: ENST00000448993
  CDS Start-End: 299-357
aatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggaatgctgatacctgattctagttatggatatggaggcaaggagaagttgttaggttaaccagcgcagtcctccgtgcgtcccgcccgccgctgccctcactcccggccaggatggcatcctgtctggccctgcgcatggcgctgctgctggtctccggggttctggcccc

SEQ ID NO: 118829 - DNA, 1844 bp, Homo sapiens
  Payload ID: 3270
  Gene Symbol: C2orf83
  Gene Name: chromosome 2 open reading frame 83
  Uniprot ID: Q53S99
  ENST ID: ENST00000264387
  CDS Start-End: 88-540
ttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaacttattaagtccatctgagaaactagagccttgggacccagggatgaggaaacttaccgtacagacatgcgggctgaccttcattcaccctgcgggccatggcctctgccatccaactgcagaggcttcagccgaaactctctccagcactgccctaaacagaccaagtgtgagggagggagcatgtaatgaaaagtccacagagaacaagaagccacaagattcggtgctctggagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcggcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccgcccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgagtcataaaacatcatttgcctttcaatttataccttccaagtgaatatgattattgaggattatctaattattatctacgtttctctctagatataaaaaacaccatagatcctatacacacaaaaatggtttttctatcagaaatggactcactcgcctggcaaaaggacacagattagattattctaatctcaaggccccttaggcttatgaattcaaaaaaaaaaatagaagaaatgaacaaaaacttaaatcacagtttgttattaagtaatatctgaaatgaattagaaagaaaccataagccttaacaatactccaatcacagttaaattaatttagacagaaaagcaaatagcaattgacttgaaaataagaagtggagccgaaggtggatacaagaaatccaggagggctaagataaatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgca

SEQ ID NO: 118830 - DNA, 2086 bp, Homo sapiens
  Payload ID: 3270
  Gene Symbol: C2orf83
  Gene Name: chromosome 2 open reading frame 83
  Uniprot ID: Q53S99
  ENST ID: ENST00000409066
  CDS Start-End: 236-526
atcccacggaatgttaaaatacattgcaccatcccatttgtctatttcttcagtctatctctgctaaaagagctttcagaaagaaactgtcaatagaaacctgggcttcctcagcagaccaaagccttgagaagaacacaattcgctgttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaactgcttcacctgtagaactgccccctcccttgtgatggttctcagctggaagagcggggtcaggagagaagtgccagttcatccatcttacgctaagtattaagtccatctgagaaactagagccttgggacccagggatgaggaaacttaccgtacagacatgcgggctgaccttcattcaccctgcgggccatggcctctgccatccaactgcagaggcttcagccgaaactctctccagcactgccctaaacagaccaagtgtgagggagggagcatgtaatgaaaagtccacagagaacaagaagccacaagattcggtgctctggagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcggcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccgcccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgagtcataaaacatcatttgcctttcaatttataccttccaagtgaatatgattattgaggattatctaattattatctacgtttctctctagatataaaaaacaccatagatcctatacacacaaaaatggtttttctatcagaaatggactcactcgcctggcaaaaggacacagattagattattctaatctcaaggccccttaggcttatgaattcaaaaaaaaaaatagaagaaatgaacaaaaacttaaatcacagtttgttattaagtaatatctgaaatgaattagaaagaaaccataagccttaacaatactccaatcacagttaaattaatttagacagaaaagcaaatagcaattgacttgaaaataagaagtggagccgaaggtggatacaagaaatccaggagggctaagataaatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgc

SEQ ID NO: 118831 - DNA, 4035 bp, Homo sapiens
  Payload ID: 3271
  Gene Symbol: C2orf88
  Gene Name: chromosome 2 open reading frame 88
  Uniprot ID: Q9BSF0
  ENST ID: ENST00000340623
  CDS Start-End: 412-699
acatgctgccacttggctgagccgggcgccggcgagaaggcggcgccgctgccctggcagctggactgcactttgcccccgcccggcctcagctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaatggttgaagtttatcctttaaaataacaatttttgtttgtttatacccaaaaaaagtccagatatgaaaagggcttttctaaaatttcttggcgagggaatggcactcaaatcatagtgattaacagtaagtcttgtttgtttgtcaaggatctctacttcttgacacaaatgaaccctgtctttaataagataagatatttatttttgtagatgagaagtgtaactaccaccttggacctcagggccctaactaattacagctgttactggacgactcagactttgtgcctaaagccatcttagagataacagtttatagaagccatgacattagtgtttattgcattgaattaagcccagtgatataactatacaagaaaacaagtaggggtaccttttacaaagagcaatccaataaatcttaaaaataacagaaacttagtctgcaaggtagaaagtttcagttttaattctgtattaagctttactatctcagaggtacagagggctggaatatgggcatttatttccagttttttcttgactagtaaggcggtcaccattaaaatagaccagataatgcatgaagatttacagttgtattgcaaaacggaaaagataaaactgtcctttgaggagagtactcgttttctgggtttttgttattttttagtggtaacacaagcctatagggcatttatagccacctattatactgtttccataagcctggctaccttttagggaagctattttttctctttcatttttactgtcacagcacatacacacacacctttttgttttaaaggattaagtactgtttgaagatcagtggtaacagaaaatttgggagggagaagaagaaattaagacatgacttgttagaaaattaagacttcagtttctagaattatcttttcatcaagatttggtagacattgagtttaaatggaaaggaaattatttaagcctgtgtatgttagatccacaatacaccattggtattgaaatataaaggttaaaaaaaaggcttatgacctctttaatgagataaatatgtatttgtcttgtaagcaggcagaaaatctacctctaattttaacactaatactttgaaacccacaatcaaatagagtgaattctccaagttacataagcaaggaaaacattatttgaaatatgccatgttttcgttgcctttggacacctcatcattcaactctaattttaccgagtcccgggatttgtactgtcccattgtacttgcaatctacaatttatataatagaaaaacaaccaaacccattcatacaaggatctgaagttataaggttaagggcagaaagtttcccataagtataaaacatttccaggtcatgaagagtagtttaggttgagtgacaaaagcctaggtgtggttgtttttcattcattttgcatctcacaccaagacatttttgctgcaaggtcatctgctgcttaaaatgtacaattaggtatataaaataagtacaatggtgaaaacacaaagccaggtaaagcagcatgccccactaaacttttcagtatacatagggacagacaagtgagttttggttgtatctaaatattttaatttcaggttccttctgtgccctgggccactatttcccaggggtgtgacagagatgcctgccagatccatatcaactagaagtctgatttctgttgctgcccttcctcagcaactatggcagtatacttttatcaccaagcaccactcccttgtccctgaatcacattttaatagagtacaatatcttctgtacaatatttctgaaacacttatgtctgaaatatatgctgtattgtatgttaacccatgacatatatgaactacaaggcttgcataatcagtgagctagtggataaatcaagacaggagcaaatgggagaaagatgaataaacaaatgaaaaaagatgaataaatgaataagagagatgaataaacaaatttacattacatgtgatagttatcatggtatggccttcatgacaagatggatgagaatatcactgataggatattagccttctttcatatctttatattgaaatatgggctttacttcaatttgaaggtctttcatgaacaataaaagagagtagaaggactgtctgagaaggcaggagacatataaaacagatgactgaaagactgactagctcctggaaagggaaacatttggaacatccagagtaagggcaaatgggcttctaccagcacaacaaagagcctccaggtggcaacatggaagcaggttatcagagaaaataaatgtgcaaattccttatttacaatgactcacttaaccccacaaacatgtttcactgctgccttccccagttgtcgcttatgtactgttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccagttgcaattaa

SEQ ID NO: 118832 - DNA, 998 bp, Homo sapiens
  Payload ID: 3271
  Gene Symbol: C2orf88
  Gene Name: chromosome 2 open reading frame 88
  Uniprot ID: Q9BSF0
  ENST ID: ENST00000396974
  CDS Start-End: 380-667
gggagccagctgttgtcatcattcaggagctatcagcctatttctacatactttatatctgttttggattatttggattccagttgtaagcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaa

SEQ ID NO: 118833 - DNA, 1441 bp, Homo sapiens
  Payload ID: 3271
  Gene Symbol: C2orf88
  Gene Name: chromosome 2 open reading frame 88
  Uniprot ID: Q9BSF0
  ENST ID: ENST00000409870
  CDS Start-End: 1093-1380
tttcattgacctctgcgatgcctcgctggcttctgctttcattgacctttgcgggtctgttcccgctgcggcgccggcagctgcttggtagttgcggggggcgtgagggcggtggcccagaccaaccggctggcagcccagctccgctccgcccgcccctgcctcggaccctgcgcctgaggaagtatcgaggcaaccctctgccacccgaagttcgtgggtcgctcccagagggcgcgccctggagccgagcgcccttgggcggccatctggaggccaggtgcgggccgcgaacccgcgaggagcgcgcggcgggcgcggcggcgacggcaggaggaggggccgggagcccgggcgccgccgaaggacgccccgtcctccacatgctgccacttggctgagccgggcgccggcgagaaggcggcgccgctgccctggcagctggactgcactttgcccccgcccggcctcagctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtgggtgactggtgaagggcgggtgtctgtcggtctttgcttgtcagctgtgccttttagatttttcaatggcagaaacccatgagttacaggaggctttaattaaacgagaccgttctcagccagctgccgtggatagagcctcacatctccgtcccctaatcgagaagagttagcccctaccccttcaattttgttctgggcttcccagtgaaaggtatctcattatgagttgcaattccaccctgctgcctacctgaagagtgagtgaagattttcaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagc

SEQ ID NO: 118834 - DNA, 570 bp, Homo sapiens
  Payload ID: 3271
  Gene Symbol: C2orf88
  Gene Name: chromosome 2 open reading frame 88
  ENST ID: ENST00000409545
  CDS Start-End: 368-570
attcgaattgttacaaagttcagctagagatttccttctccctgtggagtttcactccctgctcctctggtcaccctcctgatggatctctgtggtgccaggcaggaatggcctgctaggggatgcagcgagatcccaggtcctttctgctgcttcctctaccactgtttttcactcggctctccaaattgactcagctccaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcagga

SEQ ID NO: 118835 - DNA, 486 bp, Homo sapiens
  Payload ID: 3271
  Gene Symbol: C2orf88
  Gene Name: chromosome 2 open reading frame 88
  ENST ID: ENST00000450357
  CDS Start-End: 397-486
cagaatagactagttcatatatccaagagcagggctcctgaagggcatggactctagcttattacagacataccctggcatctagcacaatacctggcacataatagcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgcca

SEQ ID NO: 118836 - DNA, 692 bp, Homo sapiens
  Payload ID: 3271
  Gene Symbol: C2orf88
  Gene Name: chromosome 2 open reading frame 88
  Uniprot ID: Q9BSF0
  ENST ID: ENST00000443551
  CDS Start-End: 339-626
ctgccgcccgcccagacgccagcaagcccccctcccacgacagggctgctccgggagcttcggagacccgccccgggcctgagcgcaggctgcctccgggaccccacggctgtccggacgtgccatgggcgcgcagctgccgggcaacgtgttgtgtaagtgaacatctgggaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaa

SEQ ID NO: 118837 - DNA, 3721 bp, Homo sapiens
  Payload ID: 3272
  Gene Symbol: C2orf91
  Gene Name: chromosome 2 open reading frame 91
  Uniprot ID: Q6ZV80
  ENST ID: ENST00000378711
  CDS Start-End: 91-486
ttcaagcaagtcacccaggtcaagcctgttctagaagaaacaactatagcaaaagccctaaggttggagtgtggctgccagagctcacacatggtgaggatgtccagaccattattcctcgattgggcctggagacccctctgcagcccctcccaatctctcccactgacctacggaccagaaggctggattttgcaatggaagggaacttgcaggcagcagacagctctgcactgtccctttgattttcctcaggcacctctgagagggagacacactctcagccaagtacccaacaagggacatgagaaggcttctgctgtgcagctgccagagaaacaggggacagatcaaagcaggagaggaccaacatctgcggtaaccaaagcaaggacaagttaccctgagtcagaaaccttcattgtgtatttgtgcagttacttttggaactcaagtaaaggagtttacatgtcaggttccacctgaattccttccatgcttttcagcgactgaaccatttgggtggcctggaagagcctgtgagctccctggagaaaggagacagtgtggatggagaagaatctggagtagagaggagtctggggaccctgcctttcaagtcgtttgtgtgagggctgcgttggtggcccaactagccagggaagggctatggtatgcggggtcaggcgggaataggcaggaaatgtttgtgataagaggcttcgcctcttgcaagctcctctggtttccagacccagctgcaggataagggcccaggagctgagcagggagcctcagaggaggctgctgcaagagccagctcttgggatttcagcaggcagagttgcaatcagaggcccctggggtccctgaagaccatgcctggggatagaaacgaccctgggaacccagccagggctgccttcctttgggatcagggattttcaatcatacttcagagggccaaatcaatcccttaagaaaaataaaacaaaacaaaccccagctttgttaatccaagttgctgagagggtgggaagtacagacttgaccccccaggggatttcatgcgctggattggtcccagttggagccattcattaatgttaaccagtagaaatggaaaatggaagggtgcactgacaaaagaccaggctggaagctctgagaaggaatctatcccaaagggatcatctgctggggataaatagagtcatcgaacagtgtgtcatgcaggcatttgcaaagcttggtgctccttagatttccagtgtcgcctctttgcccaaggcccagtgactccaccatctgtggttgacttggccagctcacaaaggagcaagatgtgcttcacaggaacaccccatgagcggggatgaggctacaggccacttgctattgtaccagctccccttcttaaggattagcagcttctatctatccctggaggctgcactgtaaatgcctgtgtaatgctaatttgtggttggcaggagattgattgggaaggagcaggacaatggcaagaggaggctgagctccctcctcctcctggtgtaatggtgtgcttgcatgctgtgtgtgtgtgtgtgtgtgtgtgtgtgtgtgtacgtgtgtgtacgtgtgtgtcttctgggagaaatgtagcaacaagcccacagaagagatgattattcaaagagaggaagaagatttactcaccgatgcccagaatctgaaaggcatgtctggagtggagagatgggagtctatgaagcacaaatccagggagattttttgatgggaataagtgacaacccatcactcttaacatattctattcattagaaccaagtccctaagtccagcccacgcttagaggaagggattacatgggaggcaagaatcactgagagccatttcggaaactgcctacacttagaaaaacacttcaagagctcccggccaagggcctggcacatagcaagtgctcaaggaattgttacttggaccagtgactcttctaggatgtgatctaggttttcccatagtggcctgggtctctgctgtcccatctttattcctgttggcactgctgggttttcagcaaaggctttttcctctgacactgggaggtttgtgactaggctctctgggtgtgggccagcagacaggatagacgctaacttacactcttgctgtcttccgaacagcctcttcatgaccatgtgtggtcttactttgtggtcagtgtacagatattttaatttcctgctcacctgctcagaggaggatctgatttcttcttgcatttatttttctctccggcagcctgtggacaggtatttctgtctgaccatctggtagccattcacctttatggtggcttgagaaaggaatcaatttcacttgtttctttagtaatatctgcctcttttgacagcaagttacctttatcacctcttaaaattcttactatgttgcaccttctgttaccttgggggctctttcaatcccctaactttgtgcaactgcatctccctctttggtttagcttctcaggcctttctttttgcaccacggtttaatacattccatatatacttctaagtctgctggtacctctccccacccactgcctgctgagagtgacggattcttcctggctggaccaagtctaaagtaatcagaaaacaactgaaagaggaaagctgacccctgccctcatcctgcccctctgcagacttcttgaggccttttgtctaattgtggtgggtaatgtgggcagggtaaaaaatggggaagatagagcaaattttctgggcaagaatgaggggagaggtgagtggagcgtcttcatctcgctctggttttgtatcatgggtgtctccagggcctactgtctcctctgagactcctagaaagtgaggagccatggattggtatcctactaacagatggaacatcagaggcccgtggtaaggagtataataagctcagctcgccatgctctgttttgtttttgttggaagaagtgttgaaaaaaggagtggttatacactggcctatctagctatagaatacaaacacttagggtgagcagcagggaatgccttttctgaaaatgatgctgcatggaatggatgattaattccctggttaaaatgaagccagactatctttcagagtcttaagcctcctcccaataccctccacatactagtttctaattggttaatgaatatggtcactatttctagggcctgttgctccagtgtagtggtcaagagtgtacactcctatttacaatagcaaagacatggaaccaacccaaatgcccatcaatgatagactggatgaagaaaatattgtacatatataccatggaatactatgcagccctaagaaggaatgagatcgtgtcctttgcagggacatggatgaagctggaagccatcatcctcagcaaactaacacaggaacagaaaaccaaataccacacgttctcactcataagtgggagctgaacagtgagaacacatggacacagggaggggaacatcacacaccaaggcctgtctggtgtggggaggggagggagagcatcaggacaaatagctaatgcatgtggggcttaaacctagatgacgggttgataggtgcagcaatccactatggcacacatatacctatgtaacaaaccataccttctgcacatgtatcccagaacttaaagtaaaat

SEQ ID NO: 118838 - DNA, 393 bp, Homo sapiens
  Payload ID: 3272
  Gene Symbol: C2orf91
  Gene Name: chromosome 2 open reading frame 91
  ENST ID: ENST00000615044
  CDS Start-End: 1-393
atggtgaggatgtccagaccattattcctcgattgggcctggagacccctctgcagcccctcccaatctctcccactgacctacggaccagaaggctggattttgcaatggaagggaacttgcaggcagcagacagctctgcactgtccctttgattttcctcaggcacctctgagagggagacacactctcagccaagtacccaacaagggacatgagaaggcttctgctgtgcagctgccagagaaacaggggacagatcaaagcaggagaggaccaacatctgcggtaaccaaagcaaggacaagttaccctgagtcagaaaccttcattgtgtatttgtgcagttacttttggaactcaagtaaaggagtttacatgtcaggtaaagat

SEQ ID NO: 118839 - DNA, 730 bp, Homo sapiens
  Payload ID: 3273
  Gene Symbol: C20orf141
  Gene Name: chromosome 20 open reading frame 141
  Uniprot ID: Q9NUB4
  ENST ID: ENST00000380589
  CDS Start-End: 175-672
ggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtacagtctcaggacaacttagcctccaggacgcactgctgctgctgctcatggggctgggcccgctcctgagagcctgtggcatgcccttgaccctgcttggcctggctttctgcctccatccttgggcctgagagcccctccccacaactcagtgtccttcaaatatacaatgaccacccttcttcatca

SEQ ID NO: 118840 - DNA, 580 bp, Homo sapiens
  Payload ID: 3273
  Gene Symbol: C20orf141
  Gene Name: chromosome 20 open reading frame 141
  Uniprot ID: Q9NUB4
  ENST ID: ENST00000603872
  CDS Start-End: 65-562
actcccagaatgctgaccaaagtgggaggagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtacagtctcaggacaacttagcctccaggacgcactgctgctgctgctcatggggctgggcccgctcctgagagcctgtggcatgcccttgaccctgcttggcctggctttctgcctccatccttgggcctgagagcccctccccacaact

SEQ ID NO: 118841 - DNA, 571 bp, Homo sapiens
  Payload ID: 3274
  Gene Symbol: C20orf144
  Gene Name: chromosome 20 open reading frame 144
  Uniprot ID: Q9BQM9
  ENST ID: ENST00000375222
  CDS Start-End: 63-524
gggcccagggggcagagcagacggagtgtgggccatcgtccccagtggtgaccagccctgccatgggaaactatagttcccacaaaaggaccaaagcacccaagcaggcccgcaaggagaggccggctgacatggacaaggcctggtggaaatcgttcctcaaccacctcactcggaagaagccggctaccaggatcgtgctgattctccccctggacaagcggcagccgctggccaacgctgggcaacggattgactacgcgtccggcgctgggctgggctccccggcggcacccagattgcgcggagcgggcgaaggtagcgagcgcgagccgaggatgccggtactgctgctgctgcggcggcaagaggcgcggcggccggaagagggcggggccagggcagctctgagctggccgcggctgctctcgcgcttccggtccccggggaaggctccccgcgaagccggccccgccgaggagcagccgcgcaaacggtgccgctgccctcgcccgcagctttaaacgcttggcccggaccccgcccaataaagagtgcgtggcaaccctgg

SEQ ID NO: 118842 - DNA, 1034 bp, Homo sapiens
  Payload ID: 3275
  Gene Symbol: C20orf173
  Gene Name: chromosome 20 open reading frame 173
  Uniprot ID: Q96LM9
  ENST ID: ENST00000246199
  CDS Start-End: 280-729
acatgctgtctctctgccctggcctcttccaccccatgcccagtcagagaccgttttgaggcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttggtcagtggtcaacactgggcccggccatatcccccatgctttccgggcctcacccatctcccactttccgcccaaatccctgcccttggccctgtcttcacagcctctggatggagatctcacccacccagctctgttttctctcccctgggcccagcccccaatctccctcttgctgtttccagggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcttacctgt

SEQ ID NO: 118843 - DNA, 985 bp, Homo sapiens
  Payload ID: 3275
  Gene Symbol: C20orf173
  Gene Name: chromosome 20 open reading frame 173
  Uniprot ID: Q96LM9
  ENST ID: ENST00000374345
  CDS Start-End: 146-754
actgaggtattccttcccctctcaggactagccacatgctgtctctctgccctggcctcttccaccccatgcccagtcagagaccgttttgagggtagagaagccagtctacggcccaccacgggagccaccgcctgggccagacatgaagcgctggcagatttttgtcctgtgggtcttttgggtgctcatcctctggctgatgaccccctatctggatctgacacctgaatcagcaccccaggaaaaacgaatgtacttggtaccacagcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttgggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacgcctcttcttcccggtgccaggtgtcggggccaatctactgtctgccaggggcaccatcatcagggccagagatcatgattcgatacaggagtttgggcctggtggctgcctatgtcctttcattgtggctgatcacctccttcctacaccagcactccagccagaaggacctccgtaatatggccaagatacacccaggaatctgc

SEQ ID NO: 118844 - DNA, 383 bp, Homo sapiens
  Payload ID: 3275
  Gene Symbol: C20orf173
  Gene Name: chromosome 20 open reading frame 173
  ENST ID: ENST00000424444
  CDS Start-End: 189-383
agccacatgctgtctctctgccctggcctcttccaccccatgcccagtcagagaccgttttgaggcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttgggcatgaactcagggagcgagcttgggaaattgtggaggaagctgtttaaagggattcccaggctctcggtgagccattttgatttctattgtgggacttgtgtgctgttggggcgcccacagatcccgcagggc

SEQ ID NO: 118845 - DNA, 1059 bp, Homo sapiens
  Payload ID: 3275
  Gene Symbol: C20orf173
  Gene Name: chromosome 20 open reading frame 173
  Uniprot ID: Q96LM9
  ENST ID: ENST00000444723
  CDS Start-End: 146-754
actgaggtattccttcccctctcaggactagccacatgctgtctctctgccctggcctcttccaccccatgcccagtcagagaccgttttgagggtagagaagccagtctacggcccaccacgggagccaccgcctgggccagacatgaagcgctggcagatttttgtcctgtgggtcttttgggtgctcatcctctggctgatgaccccctatctggatctgacacctgaatcagcaccccaggaaaaacgaatgtacttggtaccacagcattgcgactgcccttggttcagttccgggaagtgtggctgcccttctgagaccctcaactgctcctcctgccaccacacagccgacgaatggaactggcttgatgcgtgctccaggaagactatggggtacctgatgaggacaagagagtctatgacctctgacactgtgctctggtggttgggcatgaactcagggagcgagcttgggaaattgtggaggaagctgtttaaagggattcccaggctctcggtgagccattttgatttctattgtgggacttgtgtgctgttggggcgcccacagatcccgcagggctccagccttggcaacgacatcgaccaataccccgtggttttcaggaatgccagcgaccagggctcctggatgcagctggagatgctactgcggaagctctctgacctggtgtggacttcagatgctctaagtgataagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcttacctgt

SEQ ID NO: 118846 - DNA, 6869 bp, Homo sapiens
  Payload ID: 3276
  Gene Symbol: C20orf194
  Gene Name: chromosome 20 open reading frame 194
  Uniprot ID: Q5TEA3
  ENST ID: ENST00000252032
  CDS Start-End: 69-3602
gccgccctgcgggcaactgagaccctcgcagctgcaccgtcctcctccgccgccagtcgtccgccgccatggacgtgtaccccccgcgccggcaggggctgccccgcgctcggtcccctggcggctccagccgcgggtcaccctccgtcagctgcagtcgacttcggcaggttcagagcatcctgacccagagcagcaagtctcggccggatgggatcctctgcatcctaggaatcgatagcaggtacaatgaaggctgcagagagctggcaaattatcttctatttggtttgtacaatcagaataccagtgattttgagaaaacgggattttctgaagaagtactagatgatgtaattatattgattaaatcggatagcgtccatctgtactgtaatcctgtaaactttcgctatctcttaccttatgtggcacattggagaaatctgcatttccactgcatgaccgaaaatgagtatgaagatgaagaagccgcagaagaatttaaaattaccagctttgtggacatggttcgagactgtagtagaattggcattccttacagctcccaaggtcacttgcagatatttgatatgtttgtggtggagaaatggccaattgtacaggcctttgcacttgagggcattggaggggatggattttttaccatgaaatatgagttgcaggatgtgagtttgaatctatggaatgtctacagcaagatggatcctatgtctctggagagtttgctttcagatgatttggtggcttttgaacatcagtggactagcttcttcgctaattttgacacagaaattcctttcctgctagaactttcagaatctcaggcgggtgagccattcagaagttatttcagtcatggaatgatctctagccatataactgaaaacagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacttttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatagaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttgcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcagaagagtttttaaagaggggtcggagcccgcccgtgagagcgggtcttctcaccatgtggggctgtactacgtggtggtctttgtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaag

SEQ ID NO: 118847 - DNA, 1119 bp, Homo sapiens
  Payload ID: 3277
  Gene Symbol: C20orf195
  Gene Name: chromosome 20 open reading frame 195
  Uniprot ID: Q9BVV2
  ENST ID: ENST00000370097
  CDS Start-End: 75-1031
ccgcggagtgcggagggaggctgggctctgggaagtccgcgcgcggctccgcttcagaggcaggctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaa

SEQ ID NO: 118848 - DNA, 1112 bp, Homo sapiens
  Payload ID: 3277
  Gene Symbol: C20orf195
  Gene Name: chromosome 20 open reading frame 195
  Uniprot ID: Q9BVV2
  ENST ID: ENST00000370098
  CDS Start-End: 93-1049
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaa

SEQ ID NO: 118849 - DNA, 2954 bp, Homo sapiens
  Payload ID: 3277
  Gene Symbol: C20orf195
  Gene Name: chromosome 20 open reading frame 195
  Uniprot ID: Q9BVV2
  ENST ID: ENST00000615526
  CDS Start-End: 1950-2906
agagcccgcggcgggggaagccgcccctctcctctgtccaggcgctgggtggtccatccgcctggtcaccggccactgcctctctcccaaattcctccgagggattcccgaggagtgcgctcggactggggggttgagcaggaactccctcccagtcacccgaggctcctgcgccccgcccgaagccgggggtgcgtggggagtggtgcgcccgcggaagggctccgggacgggaaccccccttggagcctggctcttggaccagccacccgccgtggcccctcagtcggggacgcgggcccccagaagtctggggctctccaggaagcgaagcggatggaagattactcggctcggggtcccgggtccccacccccgccccgcccccgggccgcagcgtcacaaaggccgctggtccccagggcaacccgcggagtgcggagggaggctgggctctgggaagtccgcgcgcggctccgcttcagaggcagggcaagtgggcgcggtcctggggcggcggcgggggccgggagaggagggctgggggtctcgagaaggtaaggggcaggcagagcggccggggaggtgggcccgggccaggggagccaaggggagtgtggtggagggggtagagtgcgggcacctggtggtctcagggaagcgggcctgggaccggggcgtgtaggaagcagcgaggggctcagaaccacctttccgggttcacgaccagcctctctgggtgttccacctgggcagctgctggagactagaaaacatccctcacacgtcacagaggcacggtttccctccagcggtgaaatccgccccagcctccagcaagagcagggcttaggcctggggtcctggggtcctgctctcagctggcacctcaccccagacacactccctgctgcccccaggggcctgttctcgagggattcccgaggagtgcgctcgtgaagtcatatctgcctcacgcccaaaagggcaacccttcccgggcagatatgacttcaccacgtacctgtgtggccctggggaactcagcaactgcttagctctcatttgtgggtcgtccaaggcccaagtggctgtgacaacctgagatctccagggttgctgggagccggggcagcaaccaggggtgcggcttgctctccagggagctgcggcagagcctggggccacagctgcactcagccggtgcacccacggacagagggtcagactcggctcagcactgggctcaagccctggatgagaacaagaaccaagcttcttagcctcaggctccatctgggaaatggagtgtcacttgtggagtccatgagctcaccagggacaggatcccgggtccacagcgagggcccacagcgtgggaggagggctgctcctccgggcccaggcctgggcgccctcctcccatgctgaccagccagctggcctcgtctttggtgaggcctgtctctgtgccctacaactgcggtgaggcgtggagcgtccccagggagaaccggagcgggaggatggcccgcgaatgtccccgagggggatcctgtgctgcttaggaccacgccgtcccctctccacggccccgaggggtgccagcaacccctttcagcagcagggttaggaactggggcccttgcaaggccacaggtcaggcggttctggccagaagtccgcagtcctagttcttccctgtcctgtcccacaggccactggttgtcagtagaggtttttgcccctcagtataaactgtgtccagatctgtaggctgcccatccagccctccaggcagcctcttcccatcgagttgtgcccccgaagaaggacagaggtccagcatggggtcagtgggctgaatccatcccccgaacatgccacagcccaggggaggccagcctgcctggcagctgacacccagccctccccccagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgc

SEQ ID NO: 118850 - DNA, 804 bp, Homo sapiens
  Payload ID: 3277
  Gene Symbol: C20orf195
  Gene Name: chromosome 20 open reading frame 195
  ENST ID: ENST00000611891
  CDS Start-End: 560-804
tgcccagtcaggcctggcccatgcccaagggcaccacagtccaacagccgcccgtgcccacggagaagtgggggttccacggagaagcgctgctgttcagcacctgcagtggttgccaagcctgagctgcactcaggtgaaaaattgcctgcttatttaagtgttggccagatattttaacatcattaaccctgcaccaggtgccgagcctccggcctctgcagtaaattctgaggacaggcgagtgagggggctctcagcaccccggctttcatgcagtaaaacgagatgctgattgcagggagctcggccgcaggccaggcacccagatgccccatgctgcccgatgaccggcttctgagtcagtcaatgcccaggccatacccaaaggccactgcggggaagtggaggctgcggacgcctggccccagttcagggggatgagcacacggagaaggggcggcgggtgagtccctggctggggacctcccaccctctccctggacagcgccaagcccccgcatgctgaagcaaactctgcccgctcagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcc

SEQ ID NO: 118851 - DNA, 1154 bp, Homo sapiens
  Payload ID: 3278
  Gene Symbol: C20orf196
  Gene Name: chromosome 20 open reading frame 196
  Uniprot ID: Q8IYI0
  ENST ID: ENST00000303142
  CDS Start-End: 88-705
ccgcgttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggcagtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaa

SEQ ID NO: 118852 - DNA, 585 bp, Homo sapiens
  Payload ID: 3278
  Gene Symbol: C20orf196
  Gene Name: chromosome 20 open reading frame 196
  ENST ID: ENST00000378979
  CDS Start-End: 92-280
gcttccgcgttccggttgcggatggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagcagatctctgagaatgcttcattgtcttaggcagaaaaacatcttacctaagcaaagctttcaggaggaacttcaaaggacagcttacctggcacagcaatgacaaggagctgtttcctggatgtctttttgttattgttgctgttaatctcaggtctctttctaatctccctcaaaatgaattcagaagcaggggaatatttggttcaacaaagagagagtggaatttttttttgttttgttcttttaaaacttcagaaaatagcaatgtgggcctgttatgtgtgatgagtaataaaaatagagactttagcat

SEQ ID NO: 118853 - DNA, 501 bp, Homo sapiens
  Payload ID: 3278
  Gene Symbol: C20orf196
  Gene Name: chromosome 20 open reading frame 196
  ENST ID: ENST00000445603
  CDS Start-End: 139-501
ggcggcttttctcctcagttttctggagtgctttggaggagagacaaggtcttgctatgttgcccaggctggtcttgaactcctggcctcaagcgatcctcccaacttggcctcgcaaagtgctgggactacaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtc

SEQ ID NO: 118854 - DNA, 627 bp, Homo sapiens
  Payload ID: 3278
  Gene Symbol: C20orf196
  Gene Name: chromosome 20 open reading frame 196
  ENST ID: ENST00000442185
  CDS Start-End: 28-627
agttttctggagtgctttggaggagagatggagtctcactcttgtagcccaagctggagtacaatgacaatctcagctcactgcaacctccgtcttccatcagcttcccaaagtgttgggattacaggcgtaagccaccacatctggcctaggattttctatatgactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggtcatccacagccaggctctgcaaactcactctctgcatctgtctgcaagtgcctgtctcagaaaatcactcaactaagaggccaggagagccaaaagtatgccctccgcagttttcaaatggcccgggtgatcttcaac

SEQ ID NO: 118855 - DNA, 1604 bp, Homo sapiens
  Payload ID: 3279
  Gene Symbol: C20orf202
  Gene Name: chromosome 20 open reading frame 202
  Uniprot ID: A1L168
  ENST ID: ENST00000400633
  CDS Start-End: 64-432
ctcattaactccatcttcagtgatttggccagaacctgctgccagtctgaaagagttgggggaatgtacaagtcaaagatccctcgggcccagaaccaggtcagtgtcaaggtcactcctaagaacactgagatgaaaatagcagaagagcccagcccgagtcttgggcagaccttggagtggctgagaaaggagctgtctgagatgcagattcaagatcagagtctcctgctcacactgaggcatcttcacagtgtcctggaggagctgcgtgcggacagcgcccactgggaggacgccaggtccagcggagggacatcccccatcagagctcgagcgggctccgaaggcaggggctgccagccggtttgctcaaggggtctggcccagctcctccgaggggaagacagcagacgaagctctctcccttaactggacggagatgacactgggctttaacactctccccattagtctaacctttcactgtgatatttcaggggcagagtgttggaatgggagtcagaaagccagggctctgggttcatttctgccctcatctgctgtgcatccctggatctgtcactcagcttctctgtgtctctggttccttttctgtcacttgggatttcttggtgaggcacacataaggtattggatgtgaacacacttttcgactgaaaacacaaatgtgctctagtgctctggcaagcaccatggcagtaaccctatccttgggaatttttcacaaggcaattgttaaaacaaagaactagatgtgcagtaatggttaccaagtgttgctatggtgaaaattccaacccctgtgtagtgacttagtggctgttttctgtcttcccaggaagccttcccattccccttcatctgataacatattaggccctgtaaccaccctggccataggcatgggtatattaccaggcctggccaatgatataattcatggttgccctaaaaagatgattggcccaatggatggtcatgtgaaccaacagagccagtcaccgaccttccctgagattgctacctggaagctctttctattacactcaggctgaggctgctggtggccatgttcctaccaggtaaagaagacctgtctgcagtaggaaggaaagaggctaatctccaaagagaagtagagagagggccacacaacagatggacagagaggaagagcgctggctctttttggtccctggttttaggtcctagttttgtgagttactcctgcattctttccagggaccgaagccagtcaatttcaccccccaacacagccacacacatcaatttgtttttggttaagctgatttgagcagtttccctcatttgcagctagaatggtcttgaggaatatgatccagatgttcaaagaatcaaagaggagaaatcaatatgaaaatggcatttcattcaatgagggtttgtgacaacaacctccgtaacagcaggcaaccaggcttgtgatacagcagagacactcagttgtgtggggtgctgcagtcataactgaaaaattgtatctgcctataagaaagactaaaacagaaaaggtgaaaataaaaaagtcatggtgttaa

SEQ ID NO: 118856 - DNA, 1114 bp, Homo sapiens
  Payload ID: 3280
  Gene Symbol: C20orf24
  Gene Name: chromosome 20 open reading frame 24
  Uniprot ID: Q9BUV8
  ENST ID: ENST00000344795
  CDS Start-End: 219-608
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 118857 - DNA, 896 bp, Homo sapiens
  Payload ID: 3280
  Gene Symbol: C20orf24
  Gene Name: chromosome 20 open reading frame 24
  Uniprot ID: Q9BUV8
  ENST ID: ENST00000342422
  CDS Start-End: 131-562
ccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 118858 - DNA, 1059 bp, Homo sapiens
  Payload ID: 3280
  Gene Symbol: C20orf24
  Gene Name: chromosome 20 open reading frame 24
  Uniprot ID: Q9BUV8
  ENST ID: ENST00000373852
  CDS Start-End: 136-549
aggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 118859 - DNA, 1170 bp, Homo sapiens
  Payload ID: 3280
  Gene Symbol: C20orf24
  Gene Name: chromosome 20 open reading frame 24
  Uniprot ID: Q9BUV8
  ENST ID: ENST00000483815
  CDS Start-End: 164-427
cggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcagattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 118860 - DNA, 1044 bp, Homo sapiens
  Payload ID: 3280
  Gene Symbol: C20orf24
  Gene Name: chromosome 20 open reading frame 24
  Uniprot ID: Q9BUV8
  ENST ID: ENST00000492721
  CDS Start-End: 168-431
ccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaa

SEQ ID NO: 118861 - DNA, 1302 bp, Homo sapiens
  Payload ID: 3281
  Gene Symbol: C20orf27
  Gene Name: chromosome 20 open reading frame 27
  Uniprot ID: Q9GZN8
  ENST ID: ENST00000217195
  CDS Start-End: 153-752
tcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggtaagtgccttcctggcgtggtaggacttgcacaagctcttccggtgggccctggtaggagggccattgctgcaggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 118862 - DNA, 1886 bp, Homo sapiens
  Payload ID: 3281
  Gene Symbol: C20orf27
  Gene Name: chromosome 20 open reading frame 27
  Uniprot ID: Q9GZN8
  ENST ID: ENST00000379772
  CDS Start-End: 812-1336
gttctgatgcttctccaggccgggccaggcacccgggacgcgtctcgggcccgcacgggggttgcttctttcgagacaggggatggggtggaaggggaagaggtccaaaccctggggtcgaaacaggagtgatggagggttcctcagctcctgaacgagaccaacacggcccgtatcgatggccgaagccggcgtggaagcccagggagaaaggccaccttcgggagctccacccagccccgagacgcgcccgacagccctcccgagagcgaagggcccaagggaggtgcgtcctaagcaaggttcaaggctagaggcgctatcccccaggcggaagaaggagcgggggcggggcctatccgaggccctccttctccctcttcgagtggtcggttctggcccctggcctagttgggccgcctgcccgtcttcctcgcgagagctcgcccggcaggcgcggactagcagggcgctgcctcggcgaccctggcacgtgacgtaggcggccctcgccagttggccgttctttggagcccgctcattggtccggagcgtccctcgccccaccctcccagatcaaccaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 118863 - DNA, 1734 bp, Homo sapiens
  Payload ID: 3281
  Gene Symbol: C20orf27
  Gene Name: chromosome 20 open reading frame 27
  Uniprot ID: Q9GZN8
  ENST ID: ENST00000399672
  CDS Start-End: 660-1184
gacgggagggcggccgcggcgcggggctcccttcctcgtgctcggcgttgagctcctgcagccgccgccgctgcagtggtcgtccctgccctccccggccccggggtgcaccccgcaaggtgaggccacccctctgctccctgcctcccggttccttcccgttcgccgaggtcccctcccggtcccggccctgtcctgagcagtcagtgcctgggaccccagcggccgtgatggcagggctggggtggggggctccgctgtcggggccgggcctggaggactccccagcacctgaactagagtgatgtcaggttcccggggcgcagtgaccgttagctggtgcagctggggtgttttccgcgaagcgattgtccgggggcatgagtgcggtagtgagggcgggggcgtaatggggtcagcgccccctcctccccacgaccctgttcattgccgctgcctcgctgcatgaccttggaccagtagcatctctgagcctccgagcctcagcaccctcaggaaggagggcagtgatgtctgggagtgcgggctccggagactcctgcgtcagccgaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 118864 - DNA, 933 bp, Homo sapiens
  Payload ID: 3281
  Gene Symbol: C20orf27
  Gene Name: chromosome 20 open reading frame 27
  ENST ID: ENST00000399683
  CDS Start-End: 1-383
gcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggataccgga

SEQ ID NO: 118865 - DNA, 803 bp, Homo sapiens
  Payload ID: 3282
  Gene Symbol: C20orf85
  Gene Name: chromosome 20 open reading frame 85
  Uniprot ID: Q9H1P6
  ENST ID: ENST00000371168
  CDS Start-End: 62-475
gagacgcgagacgctgagcccagggccagagcttgcggggcgcacagagcccccaggcctcatggcgcagaaacctctcagcaccgcggcggctgaacgcatgaaccttgtgggtcaggatgagatctggaaataccgtctgaaggctgaatcggaagcacggcagaactggccccagaactgggggtttttaacaaccccttttgaggagttgatcaagtgtgaagaagatctccccaccccaaagcccaaaatcgagcttcctgagcgtttccgcatccggccggtgaccccagtggagaagtacatcaaggtctttccatcccccccagtcccacagaccacccagggcttcatcggctggagatctgcagtgccaggcctgaacaagtgcctagagctcgacgatgcgatcagaagctgcaaaggtgcttttgcacgagagctgtgctggcccaagcagggcgtgcactgaatccagacggagttctgcccaggggtgctgcatatcggtcaccaggcacccagggccatgccagggaaaggaagagctcccctgaatcccgaggacacagtcccctgcgtacttgctcatgggatgttgcaaagaacacaaagtgtgccttagacattctcaagtcatcagcgtcacccttccagaatgttcacgtccacacccattcttggctaatgtaatgaataaggcttctctcatttgtttttgataccttgggaatttctatgcagggctttaaaaaaaaataagtgattcaattttaaaaatatttgtctaggtccttcaa

SEQ ID NO: 118866 - DNA, 1575 bp, Homo sapiens
  Payload ID: 3283
  Gene Symbol: C20orf96
  Gene Name: chromosome 20 open reading frame 96
  Uniprot ID: Q9NUD7
  ENST ID: ENST00000360321
  CDS Start-End: 140-1231
aaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaaattattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgc

SEQ ID NO: 118867 - DNA, 1420 bp, Homo sapiens
  Payload ID: 3283
  Gene Symbol: C20orf96
  Gene Name: chromosome 20 open reading frame 96
  ENST ID: ENST00000382369
  CDS Start-End: 90-1076
gggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccgtgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaaattattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgc

SEQ ID NO: 118868 - DNA, 1608 bp, Homo sapiens
  Payload ID: 3283
  Gene Symbol: C20orf96
  Gene Name: chromosome 20 open reading frame 96
  ENST ID: ENST00000400269
  CDS Start-End: 176-1264
gcgtttccttggagaccgagacgctggcgaaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaagtagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacctcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtctgacaagattcagaagaagaagaaaaaaattctgagttctgtggtggcggaaacccagcgtccctatgaagaggctctcctacagaagatgtgggaaagccaggacttcctgaaatgcatgcaaaggttcagagaaattattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgc

SEQ ID NO: 118869 - DNA, 756 bp, Homo sapiens
  Payload ID: 3284
  Gene Symbol: C21orf140
  Gene Name: chromosome 21 open reading frame 140
  Uniprot ID: B9A014
  ENST ID: ENST00000410005
  CDS Start-End: 1-756
atgcctcgctttgcaagccctcttttaagaaatgtcattatcagaagtcaatttgatggcatcaagaggaagcaatgcctccaatatctgaaaaccctgagaacactgcaatatgatggatttaagaccgtatattttggggaaaccaatatcccagaaagtctcgtaactggggaagatattagtgatggatatttcatacaaaccccaacttggtgtattgtgcatgctgcgggtagtcaaggatgggtgccttggaaatatcgggtgttcctaagagacgagctgtgtatcaaacaagaagacagcctcttctctgagttctgtgatgtggtgaggaaggcctatggaaagtgtgtcatcgtggtcaaagagagaaggcagcaggaagagcagaggccaaaggaagacagagaggctgagggccagttctatatccctacagtcattagcttagcaagcattatgtgttgcccagaggtggccaagtcctgtggccatgaactactctctctgccttccccttgtaattatctgaaccctttagactcagcctggtcttctctgaaatggtttatcatcaataacagaaacgagttttgtttgcagtccattgacagtggctattcttaccaatgtatacttttcagcaatttaattagcaaaggaattgaaaggataaacgcaagcaagtggagaacattaactagcaaagtacggagatgggaaaactactatcttgggaaattttcttaa

SEQ ID NO: 118870 - DNA, 1283 bp, Homo sapiens
  Payload ID: 3285
  Gene Symbol: C21orf2
  Gene Name: chromosome 21 open reading frame 2
  Uniprot ID: O43822
  ENST ID: ENST00000325223
  CDS Start-End: 209-976
atgagcaggagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggtt

SEQ ID NO: 118871 - DNA, 2233 bp, Homo sapiens
  Payload ID: 3285
  Gene Symbol: C21orf2
  Gene Name: chromosome 21 open reading frame 2
  Uniprot ID: O43822
  ENST ID: ENST00000339818
  CDS Start-End: 209-979
atgagcaggagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 118872 - DNA, 1634 bp, Homo sapiens
  Payload ID: 3285
  Gene Symbol: C21orf2
  Gene Name: chromosome 21 open reading frame 2
  Uniprot ID: O43822
  ENST ID: ENST00000397956
  CDS Start-End: 200-1327
agcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccggcgcccaggatgaacgtggcctgaagccgccttcccggggccagtttccttccctctcagccagggatgcctcgagcagccacaggggcagggtgagtggcgggccgctaggggccgcggctgcctctgcccactgcacccactgcacagaaaccgtggggagggagcatggagcctcacagggccccgtggggagggagcatggagcctcacagggccttgaagagctgtgccccagggggagctgcgtgtgcgggtctgtgaatgcgcacacacgtgtaacacgtgccccgcacggagccgtcctggcccctcagcctctcctgctgtcctggtctgtggaatgtgggcccgggccctgctgggctgagggcaacaggagtcacgtggaagaggtgccacacacgcgtccacaggcggggctcctctgctcagattctccgagtgtgccgaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggtt

SEQ ID NO: 118873 - DNA, 1674 bp, Homo sapiens
  Payload ID: 3286
  Gene Symbol: C21orf33
  Gene Name: chromosome 21 open reading frame 33
  Uniprot ID: P30042
  ENST ID: ENST00000291577
  CDS Start-End: 94-900
caggcgcagtcccgacgagcaacgcgtttgtagaggggtgggtgcgcacgctctgtccctgcgtgaccttccgaccccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 118874 - DNA, 1506 bp, Homo sapiens
  Payload ID: 3286
  Gene Symbol: C21orf33
  Gene Name: chromosome 21 open reading frame 33
  Uniprot ID: P30042
  ENST ID: ENST00000348499
  CDS Start-End: 19-732
cccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 118875 - DNA, 694 bp, Homo sapiens
  Payload ID: 3286
  Gene Symbol: C21orf33
  Gene Name: chromosome 21 open reading frame 33
  ENST ID: ENST00000389690
  CDS Start-End: 1-675
ccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaaga

SEQ ID NO: 118876 - DNA, 1077 bp, Homo sapiens
  Payload ID: 3286
  Gene Symbol: C21orf33
  Gene Name: chromosome 21 open reading frame 33
  ENST ID: ENST00000427803
  CDS Start-End: 81-734
gacgagcaacgcgtttgtagaggggtgggtgcgcacgctctgtccctgcgtgaccttccgaccccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcgggtgtgatgcttccacgagcctcccggcacctgctccttggtggtcctggaacgcggcgctgtgctgtccaggtctcagctgcgtctggtgctggcagggcgagagccgcacttgcgtgggtgaacatcagtgaggcgcactcgcgatggccgctcactaccgagttctgtcagccgaacaaggatgaggatctatcggaatcctctgtctccccatccacagtcactcacttaaggacctgcctggtcactgtccagggaggcccctaaagtggagcctcaggaagaggtgcaggctcagagctcctgaaggaggtccctgctgcagccgtgtcacagccggggtgaaggtttcgcccatggtctccacctcgggatcccgtccttgtcagagaagtgttccttggatgagcgcccagagggaggagcccatggccctttcttctgtgactgattaaaaatctcgatgaaacaaga

SEQ ID NO: 118877 - DNA, 1546 bp, Homo sapiens
  Payload ID: 3286
  Gene Symbol: C21orf33
  Gene Name: chromosome 21 open reading frame 33
  ENST ID: ENST00000449622
  CDS Start-End: 1-772
gcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgtgcgtatttgagctccaaggtcttccgctttccatgtggagcagatgggaagggggtgcacctgtctgctgtccaatgtggagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 118878 - DNA, 674 bp, Homo sapiens
  Payload ID: 3286
  Gene Symbol: C21orf33
  Gene Name: chromosome 21 open reading frame 33
  ENST ID: ENST00000419699
  CDS Start-End: 1-575
ctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 118879 - DNA, 2975 bp, Homo sapiens
  Payload ID: 3287
  Gene Symbol: C21orf58
  Gene Name: chromosome 21 open reading frame 58
  Uniprot ID: P58505
  ENST ID: ENST00000291691
  CDS Start-End: 1138-2106
gcggcaaaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaagcaa

SEQ ID NO: 118880 - DNA, 2900 bp, Homo sapiens
  Payload ID: 3287
  Gene Symbol: C21orf58
  Gene Name: chromosome 21 open reading frame 58
  ENST ID: ENST00000397679
  CDS Start-End: 1385-2035
ttcagggtccctacatggatgtgggttggaagacaggacaggcacacaaccatagatactgatggacatgggccatttacagaactgagggcaagagagcaattttggccactgaggcaagttcctgggttagctgcaccgaggagggtgctgacctctgcccctcgggtccacaggtctgggcccctgctgctgacatcccccacatgtcagtctgcctgctagtgggattgactaactcatcaacgtggagtttaatgcccaaccaagtgcagaccacgctcctgttttgcgtcaccctctgcgaagcttcctgcaaacttgactccctgcccagtgcccccagccccaaggtgggacatatcccctgggcaccccctctggtcctgctaaagcccagcccctctgcaggtcacaacccctcctctgtcctaccccttctgctgcctgcaatttcctgaactccttggtaggcagtctcctcaccctgtcctcccagtgtctccccaccctgtcttccctgcttgctctgagggtccctaggagggaggtattaacaccctggaggcagtacacaggtggggcgccctcccctgacacacaggttcttctggactgggtcctgaggctggtggtgcatagggggtcacgactgcccttcccccaggtctgagggttctgcccctctgcctcagctgctgcccacttttttgccttcccatgaagcccagctggccacacctggggatgagtgtttaccggtagcctgaggacgcacagtggaaacctggcaacctggggcctccctgtgtctggcagcctggcaactgtcacgcggcgcccagcgctggcttctggggcactgcagtccagggagggtgtggctatcttcccacagggctcttctcttccctcaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaa

SEQ ID NO: 118881 - DNA, 2624 bp, Homo sapiens
  Payload ID: 3287
  Gene Symbol: C21orf58
  Gene Name: chromosome 21 open reading frame 58
  ENST ID: ENST00000397680
  CDS Start-End: 1109-1759
tgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaa

SEQ ID NO: 118882 - DNA, 2941 bp, Homo sapiens
  Payload ID: 3287
  Gene Symbol: C21orf58
  Gene Name: chromosome 21 open reading frame 58
  ENST ID: ENST00000397682
  CDS Start-End: 1705-2355
gcggcaaaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaagcaa

SEQ ID NO: 118883 - DNA, 1674 bp, Homo sapiens
  Payload ID: 3287
  Gene Symbol: C21orf58
  Gene Name: chromosome 21 open reading frame 58
  ENST ID: ENST00000397683
  CDS Start-End: 657-1307
aaagaggagaggaaaaaaagttaaccagttcaacgaaaaggagaatctggcaaggaagcatctctgatgtgggcagagcctgcagcagcagatgtggagggcttctcacaagtgacagcaagactgtctgtaaaacggccactttgacctggtggtgttctgctcttttcatggccatagagtactctggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaaagcctcttagtcattcctggagcacacagggcctttgcgtggagccaccgtctctgtcacggtctctcttcctcacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgacagattctttcattcctgaagttccgcacaaggaggaaccctgtcccagtgcttccatctttgaaagtttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaaagctcagactccatttcctcttttcaaggtgactttccagcatggcatttctttctttctattaaaaatgtttttttttga

SEQ ID NO: 118884 - DNA, 1931 bp, Homo sapiens
  Payload ID: 3287
  Gene Symbol: C21orf58
  Gene Name: chromosome 21 open reading frame 58
  ENST ID: ENST00000445935
  CDS Start-End: 1796-1931
aaaagttcgcgctgctggtcccgcgcgggcggcccctgggctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttgagacagtctcgctgcgacgcccaggctatagcgcaatggcgcgatctcggctccctgcaacctccctcaggaagccgtggaagctcgaccgccagaaacttccttctcctgactcaggccacagtcttctgtgtggtctgggcccctgctgctgacatcccccacatgtcagtctgcctgctagtgggattgactaactcatcaacgtggagtttaatgcccaaccaagtgcagaccacgctcctgttttgcgtcaccctctgcgaagcttcctgcaaacttgactccctgcccagtgcccccagccccaaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacc

SEQ ID NO: 118885 - DNA, 1072 bp, Homo sapiens
  Payload ID: 3287
  Gene Symbol: C21orf58
  Gene Name: chromosome 21 open reading frame 58
  ENST ID: ENST00000417060
  CDS Start-End: 1-855
ggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagttttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaa

SEQ ID NO: 118886 - DNA, 1196 bp, Homo sapiens
  Payload ID: 3287
  Gene Symbol: C21orf58
  Gene Name: chromosome 21 open reading frame 58
  ENST ID: ENST00000491666
  CDS Start-End: 1-720
ggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacagattctttcattcctgaagttccgcacaaggaggaaccctgtcccagtgcttccatctttgaaagtttgcaggtaggagacaggatgaccagagagttgccactgagctgcagagctccccagggacagccacctggtgctgacatggacgggcaggtgtgaacaccgaagggcccagcgcagctactggcagtaacactcacttctctcagaaccatcttttcgtgcctcttgaaggtgattccagagactctgtgctctcgttaaaagctcaaaccaaagctcagactccatttcctcttttcaaggtgactttccagcatggcatttctttctttctattaaaaatgtttttttttgagacagagttttgctcttgtcgcccaggctggagtgcaatggagcgatctcggctcactgcaagctccgcctcccaggatggtcttgatttcctgacctcgtgatccacctgcctcggcctcccaaagtgctg

SEQ ID NO: 118887 - DNA, 1692 bp, Homo sapiens
  Payload ID: 3288
  Gene Symbol: C21orf59
  Gene Name: chromosome 21 open reading frame 59
  Uniprot ID: P57076
  ENST ID: ENST00000290155
  CDS Start-End: 624-1496
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaa

SEQ ID NO: 118888 - DNA, 1243 bp, Homo sapiens
  Payload ID: 3288
  Gene Symbol: C21orf59
  Gene Name: chromosome 21 open reading frame 59
  ENST ID: ENST00000300260
  CDS Start-End: 361-777
cttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaa

SEQ ID NO: 118889 - DNA, 2503 bp, Homo sapiens
  Payload ID: 3288
  Gene Symbol: C21orf59
  Gene Name: chromosome 21 open reading frame 59
  ENST ID: ENST00000382549
  CDS Start-End: 344-1081
agaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaa

SEQ ID NO: 118890 - DNA, 863 bp, Homo sapiens
  Payload ID: 3288
  Gene Symbol: C21orf59
  Gene Name: chromosome 21 open reading frame 59
  ENST ID: ENST00000458138
  CDS Start-End: 313-863
ggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaac

SEQ ID NO: 118891 - DNA, 873 bp, Homo sapiens
  Payload ID: 3288
  Gene Symbol: C21orf59
  Gene Name: chromosome 21 open reading frame 59
  ENST ID: ENST00000425336
  CDS Start-End: 1-352
ttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaag

SEQ ID NO: 118892 - DNA, 417 bp, Homo sapiens
  Payload ID: 3288
  Gene Symbol: C21orf59
  Gene Name: chromosome 21 open reading frame 59
  ENST ID: ENST00000431599
  CDS Start-End: 1-239
agctgagaagaacgaagaagctttcagactacgtggggaagaatgaaaaaaccaaaattatcgccaagattcagcaaatttttgccactttccaggtggtcgttctttgtcctcctgagcttgggcctcgctccttgggacccctggaccagaaccccaatcagctcaggaacaggcttctggcagatgagcccggcggcagtggagcgagagatgcagtgagcaatgtggctccataagcacagtacaatgcatatcctttcagccacgtctttgtttatttcattagctttgctttatgaaatatttcaagaactggcattgtgtgcaaggctctagaagaattttttgcatgtgtttgattttaattttctctgtttgctttttagtaattaagagtaaagtcaaccaagaaca

SEQ ID NO: 118893 - DNA, 1082 bp, Homo sapiens
  Payload ID: 3288
  Gene Symbol: C21orf59
  Gene Name: chromosome 21 open reading frame 59
  ENST ID: ENST00000440966
  CDS Start-End: 110-886
gctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaa

SEQ ID NO: 118894 - DNA, 878 bp, Homo sapiens
  Payload ID: 3289
  Gene Symbol: C21orf62
  Gene Name: chromosome 21 open reading frame 62
  ENST ID: ENST00000382373
  CDS Start-End: 1-801
tgcagattaaaccagctgtcaagccagggtgaaggatccgtggccaggcagaggtctgtggagtggagaggcgaggcctcacggtggaactctcagatgacagcatgcaggcaccaagagagtggacgcacatacagaagacagccatgcactgagctggggacatgcaacaataacagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccg

SEQ ID NO: 118895 - DNA, 1009 bp, Homo sapiens
  Payload ID: 3289
  Gene Symbol: C21orf62
  Gene Name: chromosome 21 open reading frame 62
  Uniprot ID: Q9NYP8
  ENST ID: ENST00000487113
  CDS Start-End: 153-812
accagctgtcaagccagggtgaaggatccgtggccaggcagaggtctgtggagtggagaggcgaggcctcacggtggaactctcagatgtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacactttt

SEQ ID NO: 118896 - DNA, 964 bp, Homo sapiens
  Payload ID: 3289
  Gene Symbol: C21orf62
  Gene Name: chromosome 21 open reading frame 62
  Uniprot ID: Q9NYP8
  ENST ID: ENST00000479548
  CDS Start-End: 264-923
ctgtggagtggagaggcgaggcctcacggtggaactctcagatgacagcatgcaggcaccaagagagtggacgcacatacagaagacagccatgcactgagctggggacatgcaacaataacaggccatacaatgaaagtcgctgaagaagaatatgaattttgcctgcggatttgctaacactcgacaatcctaggaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatga

SEQ ID NO: 118897 - DNA, 1155 bp, Homo sapiens
  Payload ID: 3289
  Gene Symbol: C21orf62
  Gene Name: chromosome 21 open reading frame 62
  Uniprot ID: Q9NYP8
  ENST ID: ENST00000490358
  CDS Start-End: 298-957
cctccgaagacggaaaagaacagcaagtgcaagaccacgcattccaccctggcttgcagattaaaccagctgtcaagccagggtgaaggatccgtggccaggcagaggtctgtggagtggagaggcgaggcctcacggtggaactctcagatgacagcatgcaggcaccaagagagtggacgcacatacagaagacagccatgcactgagctggggacatgcaacaataacaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacacttttg

SEQ ID NO: 118898 - DNA, 3889 bp, Homo sapiens
  Payload ID: 3289
  Gene Symbol: C21orf62
  Gene Name: chromosome 21 open reading frame 62
  Uniprot ID: Q9NYP8
  ENST ID: ENST00000536776
  CDS Start-End: 142-801
aggccatacaatgaaagtcgctgaagaagaatatgaattttgcctgcggatttgctaacactcgacaatcctaggaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacacttttgaaaaacaaaagaaaaagaaaccaaaaaaccaacttgattccgtccagggacatgtcttgggagccagctaggcttggtctctgcaactagaagcctgcagggaaatgtcccgtcagaaatggagaaagcaatacaccctagagactgcttagtggagctcctcctagaaggtgacccccaagaaacatatcttctttcaaaatactgccttaatttttttctgtttcattttgtgaaattgcttggaattcccctaagtagagaataatcaatttcagaggtttggggactatgagttttataaaatggtcgggcacagtggctcacacctgtaatcccagcactttgggaggccgaggcgggcggatcacctgaggtcgggagttcaagaccagcctgaccaacatggagaaaccccatctctactaaaaatacaaaattagccgggcatggtggcacatgcctgtaatcccagctactcggaggctgagcaggagaatcgcttgaacctgggaggcggaggttgcagtgagccaaaatcgtgccactgcactctacactccagcctgggtgacagagtcagagatcacaccattgcactccagcctgggcaacaagagcgaaactccatctcaaaaaaaaaaaaaataataataataaaatgattaggttctcttaaactgatcttttctaaataccttgctaagaatagatgcaccaagaaataagaggttggagactgtgtttgttggggtggaggtaccacaggcatggatagggtaagaccttaggatcaaatggggggaccagtgttccagagagagggatgcagcagtgaaaattggaggacacaaaacacatttgcatctatctcaaaattttgcttagagcacagcctaactgcaaggaaagttcttcacttctagcctttcacattcttttccttttctttctttgcatggtctgtctttgcccctgctataccatttcaccaatttctcttctcattttcatcttctttctcctactccttttcctcttgctccaaaaatcagaacttagatgaataccattcaagctatgtttaactacattaggggctagcctgggaatttactcaccacttacaacattatttctattgttaaaagtgctcaaattattaacagataattaacaaaaaaacatctaaggctcaatccatttggaaggttaagattgcaaagtgaaggcattttatatgacacggttaacacaaaatgattttatgtgtgctgataaaaggaaccaaagcaacatacttttgaaaaaattaaatggattcattattgtacaaagaaaattttccctcatagagacgcaacttgccattaaagtggactgtaaagaatccatggcttgggaggccgaggcaggcggatcacctgaggtcgggagttcgagaccagcctgaccaacatggagaaaccctgtctctactaaaaatacaaaataagccaggcgtggtggtgcatgcctgtaatcccagctactcaggaggctgaggcaggagagtcacttgaacctgggaggcggaggttgcagtgagccaagattgcgccactgcactccagcctgggcaacaagagcaaaactccatctcaaaaaaaaaaaaagaaaagaaaaaagaatccactgcaattgtgatacaaatgtctaaacctggagtggaatgaatttgaaacattattgcattcatgataccataatgataagaaatagtccatgacttaacaggatatcctggggttgatgactttagatcacatacatcacttttttttttttttcacttaaccttaacatagagtaactgaaataatctgcaatttctacatttgcttaattggtgggggatttagccattcaggctaattagcatgagcccatgtcagtgtttaaattaggccaaaacaaagaccaaagtatgaattttaatagaaaaatgtgacctcattactgacattgtactgcagataatgttaaagtgaaagaaaaaataaggaaaaggggaaaaaggaggaaaaaggaaagcaagaaaagacaagtgaaaagattagtaatatattcattgtcattagttactgaaaatataacaaattgaattttaataatttttattaataaagtataaaattaaatgatgatagaaagtatatgcctcctataaatatcttccatttggtagcttttaatagtttcaaagccctttcacatatgttttaagtaagtcttttgagaaatacttgtgagttaatgggacttaaaccaacagaaaaggaaagctaatttagttataaatcaagcctgaggtttcagatttctggactaaaaatatggttcagtttgtgctgctgtgggatgaagaatgggcagagaaaatccacagtgcaggcatggggattaatggcatttggcacttagctgcagggtttgggggacaacagggagtggtgggatggtggttaagtaagggtgcatgccccacctgaagctctacagtggctcagctccaactgagtgttgccatgggaaaatctgatggggccagatctgatccttcagagaatgaggaattccaggttgttatgtgaattctcacaatttgtaaatgtcggcttgccattcagcttttttgtttgtttgttttaaataatatcatgtgggtcaaacaaactatgttaatggtagccatctggcctggggctagtagcttattgcctctggccagtggtgtgctaacaaaagtttaaccagcagctctccaacaaaaaagggaggtgggctgctctgcctatgcagtagccatgcttttattcctttactttgttaataaacttgctttcacttt

SEQ ID NO: 118899 - DNA, 1009 bp, Homo sapiens; identical to SEQ ID NO: 118895
  Payload ID: 3289
  Gene Symbol: C21orf62
  Gene Name: chromosome 21 open reading frame 62
  Uniprot ID: Q9NYP8
  ENST ID: ENST00000576061
  CDS Start-End: 153-812

SEQ ID NO: 118900 - DNA, 878 bp, Homo sapiens; identical to SEQ ID NO: 118894
  Payload ID: 3289
  Gene Symbol: C21orf62
  Gene Name: chromosome 21 open reading frame 62
  ENST ID: ENST00000573131
  CDS Start-End: 1-801

SEQ ID NO: 118901 - DNA, 1155 bp, Homo sapiens; identical to SEQ ID NO: 118897
  Payload ID: 3289
  Gene Symbol: C21orf62
  Gene Name: chromosome 21 open reading frame 62
  Uniprot ID: Q9NYP8
  ENST ID: ENST00000576372
  CDS Start-End: 298-957

SEQ ID NO: 118902 - DNA, 964 bp, Homo sapiens; identical to SEQ ID NO: 118896
  Payload ID: 3289
  Gene Symbol: C21orf62
  Gene Name: chromosome 21 open reading frame 62
  Uniprot ID: Q9NYP8
  ENST ID: ENST00000571812
  CDS Start-End: 264-923

SEQ ID NO: 118903 - DNA, 3889 bp, Homo sapiens; identical to SEQ ID NO: 118898
  Payload ID: 3289
  Gene Symbol: C21orf62
  Gene Name: chromosome 21 open reading frame 62
  Uniprot ID: Q9NYP8
  ENST ID: ENST00000610926
  CDS Start-End: 142-801

SEQ ID NO: 118904 - DNA, 5433 bp, Homo sapiens
  Payload ID: 3290
  Gene Symbol: C21orf91
  Gene Name: chromosome 21 open reading frame 91
  Uniprot ID: Q9NYK6
  ENST ID: ENST00000284881
  CDS Start-End: 92-985
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttgtaaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccagtgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcaattactgtgtatgcaaatataagtatcaggtacagagttgagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttataatgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcgtatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttatctgcta

SEQ ID NO: 118905 - DNA, 1090 bp, Homo sapiens
  Payload ID: 3290
  Gene Symbol: C21orf91
  Gene Name: chromosome 21 open reading frame 91
  Uniprot ID: Q9NYK6
  ENST ID: ENST00000400558
  CDS Start-End: 92-757
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactcta

SEQ ID NO: 118906 - DNA, 1593 bp, Homo sapiens
  Payload ID: 3290
  Gene Symbol: C21orf91
  Gene Name: chromosome 21 open reading frame 91
  Uniprot ID: Q9NYK6
  ENST ID: ENST00000400559
  CDS Start-End: 92-982
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaa

SEQ ID NO: 118907 - DNA, 896 bp, Homo sapiens
  Payload ID: 3290
  Gene Symbol: C21orf91
  Gene Name: chromosome 21 open reading frame 91
  ENST ID: ENST00000405964
  CDS Start-End: 170-896
cccggagcgatgggacgaggctctcccgcccgccgggctccaggatgccgcggctctcccagctccggcttgggcccctccggcggtgcccggccggtaccgtgaagccgccgctcggccttcggtgtagttgccccggacacggcgggacgccctccccgggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccagg

SEQ ID NO: 118908 - DNA, 681 bp, Homo sapiens
  Payload ID: 3291
  Gene Symbol: C22orf15
  Gene Name: chromosome 22 open reading frame 15
  ENST ID: ENST00000305199
  CDS Start-End: 101-574
cccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaagagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118909 - DNA, 646 bp, Homo sapiens
  Payload ID: 3291
  Gene Symbol: C22orf15
  Gene Name: chromosome 22 open reading frame 15
  Uniprot ID: Q8WYQ4
  ENST ID: ENST00000382821
  CDS Start-End: 85-513
gtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaaggtggcccaagagggagaggacatggcctccacccgctatgagtccctattggagaacctggatgaccattacccagagctggcaggtgcaaacagacaacaacccagcaggactcctcttgcagaatctggaattgctgagaagttgcatcagcaagaggggcaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118910 - DNA, 829 bp, Homo sapiens
  Payload ID: 3291
  Gene Symbol: C22orf15
  Gene Name: chromosome 22 open reading frame 15
  Uniprot ID: Q8WYQ4
  ENST ID: ENST00000402217
  CDS Start-End: 254-700
gggctcagtggggaggaagaggaggccaggagtcttggactagctgcagggtttgagctaggctgaagcagcagaaccacagaggtggctgagcaggggcctggccctgggacccagccatccacactcacacatccacttctccctccagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcaagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118911 - DNA, 476 bp, Homo sapiens
  Payload ID: 3291
  Gene Symbol: C22orf15
  Gene Name: chromosome 22 open reading frame 15
  ENST ID: ENST00000614752
  CDS Start-End: 56-454
ccctgtccggcctcccacctcggctggggacctagccccaatccatccctacccaatgctctgctcccagcctggactagcaaacagttccagagtgagaggcagagtagggaccattaggccagtcaggtgtccttcatcgtctctccacatgtcacagagggagaggacatggcctccacccgctatgagtccctattggagaacctggatgaccattacccagagctggcaggtgagtgtcagggtacagcccagggggagggcacaccttctccctaacccctaccaacaggacttcctgggccttccagaggaactgcgcaggctgtcaggcctctcctctgtgggccacaactggaggaagcgtatgggcactcggcgaggccgccatgagcaaagccccacttcaaggcccagaaaggtgagctccctgccacccaggagttgctagctggggcagggagccaggtaca

SEQ ID NO: 118912 - DNA, 537 bp, Homo sapiens
  Payload ID: 3291
  Gene Symbol: C22orf15
  Gene Name: chromosome 22 open reading frame 15
  ENST ID: ENST00000627601
  CDS Start-End: 1-404
ctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaaggtggcccaagagggagaggacatggcctccacccgctatgagtccctattggagaacctggatgaccattacccagagctggcaggtgcaaacagacaacaacccagcaggactcctcttgcagaatctggaattgctgagaagttgcatcagcaagaggggcaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118913 - DNA, 556 bp, Homo sapiens
  Payload ID: 3291
  Gene Symbol: C22orf15
  Gene Name: chromosome 22 open reading frame 15
  ENST ID: ENST00000626888
  CDS Start-End: 1-449
ctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaagagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118914 - DNA, 551 bp, Homo sapiens
  Payload ID: 3291
  Gene Symbol: C22orf15
  Gene Name: chromosome 22 open reading frame 15
  ENST ID: ENST00000630973
  CDS Start-End: 1-422
ctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcaagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgca

SEQ ID NO: 118915 - DNA, 1560 bp, Homo sapiens
  Payload ID: 3292
  Gene Symbol: C22orf23
  Gene Name: chromosome 22 open reading frame 23
  Uniprot ID: Q9BZE7
  ENST ID: ENST00000249079
  CDS Start-End: 258-911
agcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 118916 - DNA, 765 bp, Homo sapiens
  Payload ID: 3292
  Gene Symbol: C22orf23
  Gene Name: chromosome 22 open reading frame 23
  Uniprot ID: Q9BZE7
  ENST ID: ENST00000403026
  CDS Start-End: 62-715
aatcacttccgggaggcaggacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtcca

SEQ ID NO: 118917 - DNA, 1517 bp, Homo sapiens
  Payload ID: 3292
  Gene Symbol: C22orf23
  Gene Name: chromosome 22 open reading frame 23
  Uniprot ID: Q9BZE7
  ENST ID: ENST00000403305
  CDS Start-End: 210-863
agagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggttcatta

SEQ ID NO: 118918 - DNA, 563 bp, Homo sapiens
  Payload ID: 3292
  Gene Symbol: C22orf23
  Gene Name: chromosome 22 open reading frame 23
  ENST ID: ENST00000418863
  CDS Start-End: 78-563
atagtagcgagaggcgctagctgccagctccagcagcccagatcgcgcagtatttctgcgtggcaccgagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtg

SEQ ID NO: 118919 - DNA, 758 bp, Homo sapiens
  Payload ID: 3292
  Gene Symbol: C22orf23
  Gene Name: chromosome 22 open reading frame 23
  ENST ID: ENST00000422191
  CDS Start-End: 397-758
tgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctgggtcagaatgaggactgtgtgtgtgtatctgtgtgtctggatgggaggtttgggcactgtcgcaatattaactggcggcatcattctctggctcgatccccgcttccagacttctgggggtgttgggcgtcggggaacagagattagggacaggagacagggggtgtgtcattgcgtctttccctcctcagagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaa

SEQ ID NO: 118920 - DNA, 1777 bp, Homo sapiens
  Payload ID: 3292
  Gene Symbol: C22orf23
  Gene Name: chromosome 22 open reading frame 23
  ENST ID: ENST00000619227
  CDS Start-End: 62-652
aatcacttccgggaggcaggacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagaggaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacagggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggttcattatccctctgtgaaaactaagtctcaacaagataccacaaccaagggcatttacctggcaagcagtgcattcaggattaaaagttggctttagctttatgtctttccactatacccatggccacagaaagaaacatgaaaaggtgggagcgacctagagccctggcctgggagttccaatccctgcatgtgccgcgtgacctttcttgggcaaaacccaccagctccgtgcttgtgcatctgcgaggccctgctgggaaggagtcacctgacaccttgtcctgtacacagcacatctgtccccctcccctctggctcctgacacccacgatccctgccttctccggtattctgtcatttgcttgtcccactaaatcaccaaaatattttggaaatatcaaccttgtctcgggcacctggagggagtcccataatcccatcaggtcacatgacccaagtttcggtttgcagaat

SEQ ID NO: 118921 - DNA, 6619 bp, Homo sapiens
  Payload ID: 3293
  Gene Symbol: C22orf29
  Gene Name: chromosome 22 open reading frame 29
  Uniprot ID: Q7L3V2
  ENST ID: ENST00000328554
  CDS Start-End: 504-1598
gttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaa

SEQ ID NO: 118922 - DNA, 6785 bp, Homo sapiens
  Payload ID: 3293
  Gene Symbol: C22orf29
  Gene Name: chromosome 22 open reading frame 29
  Uniprot ID: Q7L3V2
  ENST ID: ENST00000405640
  CDS Start-End: 670-1764
gatgtaatcggtctctggacgctgcgcggcgctcctaggagcaggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgcccgctccttgcctggcctcacggcggccgatctcgttctccactttctaggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaa

SEQ ID NO: 118923 - DNA, 6523 bp, Homo sapiens
  Payload ID: 3293
  Gene Symbol: C22orf29
  Gene Name: chromosome 22 open reading frame 29
  Uniprot ID: Q7L3V2
  ENST ID: ENST00000407472
  CDS Start-End: 400-1494
gtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggaggtggtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgggacctcgttcctgtatggggtttctgtgtctgtccccctagccccaccctctctgctccctgtgacttctgtcccagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaacaccttcctggaaagtaggaagaaaaagcagaaatgtgaattggaaatacagccaactattttaggaaaaactaattagcaagcatctgattaaacttattcagaaactggccgggagcagtgtctcacacctgtaatcccagcactctgggaggccaaggtgggtggatcacctgaggtcaggagttcaagaccagcctgaccagcatggagaaatccatctctcctaaaaatacaaaattagccaagtgtggtggtgcatgcctgtaatctcagctacttgggaggctgaggcagaagaattgcttgaacccaggaggcagagggtgtggtgagccgagatcacgccattgcactccagcctggacaacaagagtgaaactccatcccaaaaaaaaaaaaacaacaaaaaacaaaaaccttatttagaaaaatataaattgttgggattattttatggtaactatcactagaaaaggctctgggttcagatggttttatgtgtgagttatttcagggcacagataccttgtaggtaaaacaactggaaaccttggaaataggtgggaagctatttttagaaagcaggtatagccctggtagcaaagcaagtgagctggcagaagaaacccattttcagtcttgattctggtcagatgtgagaagtccctggatgtcctggcccagccccatgcttctgtgccaggtcacagctgccctccgtccgatgactcaggccccatccccccttttgtgggttgggtcagactgctccctgatgcctacctccagtgcactgtggcctggctcacctgtgggtctggcagtagaacccagagttgctctctaggatggacagcctagtcacccagctgacctttaccctgtcccacaggcttctggacaggccaccttccccatctccctttagtggacctgaagtggatactccagcctgggattgctgccttctcttttgaaccctgtcctattggggctttggggcttttgtgcccttgggacccaggcagctcctgggggtgtgtgagttatggtctgccgtgtgtctgagggccagtcatgcagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaagccactga

SEQ ID NO: 118924 - DNA, 730 bp, Homo sapiens
  Payload ID: 3293
  Gene Symbol: C22orf29
  Gene Name: chromosome 22 open reading frame 29
  ENST ID: ENST00000416337
  CDS Start-End: 458-730
agtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccc

SEQ ID NO: 118925 - DNA, 995 bp, Homo sapiens
  Payload ID: 3294
  Gene Symbol: C22orf31
  Gene Name: chromosome 22 open reading frame 31
  Uniprot ID: O95567
  ENST ID: ENST00000216071
  CDS Start-End: 53-925
tatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttc

SEQ ID NO: 118926 - DNA, 1221 bp, Homo sapiens
  Payload ID: 3295
  Gene Symbol: C22orf39
  Gene Name: chromosome 22 open reading frame 39
  ENST ID: ENST00000333059
  CDS Start-End: 10-327
cgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagctatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaa

SEQ ID NO: 118927 - DNA, 3350 bp, Homo sapiens
  Payload ID: 3295
  Gene Symbol: C22orf39
  Gene Name: chromosome 22 open reading frame 39
  Uniprot ID: Q6P5X5
  ENST ID: ENST00000399562
  CDS Start-End: 434-862
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagctatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaacactatttcttgaagaggtctgtttattactaatagaatggtttctcatcctatggtggccctgttgtgtgatgctgagggctaggctgggtctgtgcccagcaccctccctgctctcttcctggacacaggcagcaagttgaatatcttttaatttgttctttggggcagaataatctatcacgttagaagggtgtccattaaagaacagtatttccctgcttgagtgtgttttctcctgtgctccctaagagcccctgtgtctgtgaacagtgggggtgggggtgggggttgtgctcacgggatcccaagagcaggagcatctaaagaggagccagcgttcccccatcatcaggggagtactgatgtgtctaaggcaaccagggtgcctccagcatggctgtggctggtttaataatgagcatttccacccagtgagggaagagaggaagactgctagagatctacaaggtttttcttactcttaaacacagggacggggcatctgaatttgcagtctgctgtaatcccagcactttgggaggccaaggtgggtggatcacttgaggtctggagtttgagaccagcctggccaacatggttgaaaccccccatctctattaaaaatacaaaaattaactgggcatggtggcacgtgcctgtgatcccagctactcgggaagctgagacaggagaattgcttgaaccccagaggcagaggttgcagtgagctgagatcgtgccactgtactccagcctgggcgacagagtgagactcttgtctcaaagataaaataataaaatgagtttgcagcctgcatgtgatgcctgggattgcagcagctgccttcaggttcctggggcagagctggagagtgcagcaaaagccagggcatgccagccagcaccccagtccatgaggggcttcccctcagtgcagccacgctccctgccacctgcttgtttagcaaggtatgcattgtgcggctgcatgctctgttaggaagcattaagtcctgcctctgtagtgtgactatcatgttttgcctcctccttcactactcaagttccacatcaacagataatctctctggacaggatgttcctgcatttgtttctatgtcaattgcttcacaacatctgagtgtccacatgttggacagggtttgaggcttataagaccacagttttgaaacagacaagttgtcttcaaagagtttctgttgtagtttgggtaaaagacagacattaaacatcaataaataggaatttaaaacggtggctggatgtggtggctcacggctgttatcccagcactttgggaggctgaggtgggaggattgcttgagcccaggagttcgagaccagcctgggcaacgtaacaagaccccatctctacaaaaaataaatgagctatgcatggtggcgtgcatttgtagttccagctacttcggaggctgagataggaggattgtttgagcccaggagtttgaggctgcagtgagccatgattgtgccccactgcacttcaacctgggtgacagagcaatatcctgtctcaaaataaataaaaataaaatggtggtaatttctg

SEQ ID NO: 118928 - DNA, 1005 bp, Homo sapiens
  Payload ID: 3295
  Gene Symbol: C22orf39
  Gene Name: chromosome 22 open reading frame 39
  ENST ID: ENST00000399568
  CDS Start-End: 5-247
agacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttcaaaataaaaagttgaaaacaaa

SEQ ID NO: 118929 - DNA, 2979 bp, Homo sapiens
  Payload ID: 3295
  Gene Symbol: C22orf39
  Gene Name: chromosome 22 open reading frame 39
  ENST ID: ENST00000509549
  CDS Start-End: 4-282
gacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtc

SEQ ID NO: 118930 - DNA, 1523 bp, Homo sapiens
  Payload ID: 3295
  Gene Symbol: C22orf39
  Gene Name: chromosome 22 open reading frame 39
  Uniprot ID: Q6P5X5
  ENST ID: ENST00000542103
  CDS Start-End: 434-787
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttc

SEQ ID NO: 118931 - DNA, 1977 bp, Homo sapiens
  Payload ID: 3295
  Gene Symbol: C22orf39
  Gene Name: chromosome 22 open reading frame 39
  Uniprot ID: Q6P5X5
  ENST ID: ENST00000611555
  CDS Start-End: 434-862
atatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggtagctgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggcggtcctgaggtctaggcttctcaggtaaactgaagggtagccctgacctgtgtggacacacaggtgggtcataatgaggtagctaaacagttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagctatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaacactatttcttgaagaggtctgtttattactaatagaatggtttctcatcctatggtggccctgttgtgtgatgctgagggctaggctgggtctgtgcccagcaccctccctgctctcttcctggacacaggcagcaagttgaatatcttttaatttgttctttggggcagaataatctatcacgttagaagggtgtccattaaagaacagtatttccctg

SEQ ID NO: 118932 - DNA, 1363 bp, Homo sapiens
  Payload ID: 3296
  Gene Symbol: C22orf42
  Gene Name: chromosome 22 open reading frame 42
  Uniprot ID: Q6IC83
  ENST ID: ENST00000382097
  CDS Start-End: 74-829
gtagaaggaggaggagctccgactacattctgtccttgtgcctcttggacttttttgtgtgtttaggtgcccaatggggagcaaactgacttgctgcctgggccccagcgggggcctcaactgtgactgctgcaggccagatgtgggaccctgccatgagtgtgagattcctgagactgtggcagccacagcaccagcatccaccactgcaaagcctgccaaattggatttgaaagctaagaaggcccaactcatgcagtacctcagcctcccgaagacgccgaagatgctgaagatgtccaaaggtttggacgcccgctccaagcgctggttaaaaataatatggagacggcacgggatttggcctctagaaaatataggtcccactgaagatgtgcaggcgtctgcacacggcggtgtggaggagaatatgacatcagatattgaaatacctgaggccaagcacgaccaccgtcccactgaagatgtgcaggtgtctgcacacggcggtgtggaggagaatataacgtcagatattgaaatatctgaggccaagcacgaccaccatttggtcgaagatctcagtgaaagcctatctgtctgtcttgaagacttcatgacatcggatctcagtgaaagcctatctgtctctcttgaagacttcatgacatcaggtctcagtgaaagcctatctgtctctcttgaagacctcatgacaccggagatggcaaaggagagatatgaagattacctctgctgggttaagatggcacggtctcggctcaatgaacccatcagcagccaggttctaggacttctccggctttagtgttccaagtagctgggattacagacgcctgccatcacgcccagctcaaatcattttatgaatgcatatttccatctgggtgaaaaaaaaatcacaagcctctctctcttcctactgagcacctgtgaacagtgacctgcagtttgtggctgcagccagtcctcttgcagcctggtgttcttacatttcattctgaggctcacattctcagtcaccatgcagaagaacacccgccccatcctgggtcattacagagtgggtcaatccatctgctgcatctgaagagctgggtccagcttctacagtgaatccatatatttctgtatttcctggataaggaagagcaaaggagctgagctggtggaggaagaagaactaatattaactgactccttattttgtgctagtactgtgctagttacatattttatctcatgtaattcttaccaaactgtaagggggtttcggagtgatggagacaatattgatgttatctccattttagggtgagaaaataaaggctcagaaatgtta

SEQ ID NO: 118933 - DNA, 4975 bp, Homo sapiens
  Payload ID: 3297
  Gene Symbol: C22orf46
  Gene Name: chromosome 22 open reading frame 46
  Uniprot ID: C9J442
  ENST ID: ENST00000402966
  CDS Start-End: 86-817
ggctatcctactgcagctggctgcatcagatgtgccaggcctgccctctagctcccaacaccatctgcctgatctaagctttgccatgttgttgtcactgctgggtgcctgtgctgtggtggggccattccatggccctgagtgggagccagtgcagggcctgctctcccagaatcacagctgcagggaccctcagtgctgtggcaacctgcttgtcctctgcctctttctggtctggcaggtccggcactgttggcaccaggtcaccaggacccgcttcagcacaaggaatgtcatcaaggtgccactgcagaagcgggcagtgccctccatgaggtgcgaaactgtcttcaagctgactcctgaattcttcagtcctggaaagtccaggggcctagattctcaacaatgcgcacaaaggcagagatggggataccggaggagcctccaggaatcatgggcccagaacctgctctctccacagcacccatgtccaggcccaccttcgggtgtccacacccactctgagcccatcttttgtaccacctccatttcaaacacctgtttactgcctcagaacagttcctggaaagcatggcaggtgccttggtgtctccatgatggtcagactcgccctgccttggacatgtgtcaagagatggagcagctgctgcttcactcacaggaaaggttggtgtcactggagcctgtcatcagtgtgaggtctcgccccacctccatgaccttaaccacctctcttccaaacttactttcagctgagaggctgcagttctgcccccagagagctcctgcctgatccttcccaccaaacactgagaatgtgcacttggaagtcttggcactgtcgaccagaggcctgggaaccagggggtaaaaaccagaaagcaggcagagaggatagtagagagacccaggctccaaggtgggtgaaccagacagggagcagacgggaggatgcttcagaaatccaggcatctggggagtagttcccagtagactttggaatggagggtgatgcagagactaacgtgttggagtgtgcaaaccagagactagtaataagtgaaactgatggcgagatcttgacaccagggtgggacacccaggaccggatgggagttgagagtagaaccaacattcaggaactagggaatagaaaccagagggaggctggaggtgagaatctccctgaaacccaggcacatatgggagagaaccaagaacagttaagatgtaaaattgatgcagagacccaaacacctgagtgggagaaccaggataagaatggaagtgaggatgctgtggagacccagacatttgagaagaaggacaagaaagaggctggagaggaggatggggaagagatccaggctcaaggattggggaagcaaggccagactggagatgagaatggtgaggagacccagacaccacagtgggagaaacaagatcagatgaaaggtgatgcggatgtggaaattcagatggaagaggggagaaacaaggatcaggttggaggtcaggatgctgcacaaacccaatcatgtgggagggagaacgtgggagaagtaaaaaaagagaatagtgtagagacccaggccttggattggggaaaacaggaatgtgttggaaatgggaatgttacagagatccagacaccaaggtgggagaagcatgatcaaggtggaagtaagaaagctaagaagacccaagcatctgggggagagaaccagaaacaattaagtcatgaaattcaagtggggtggggaaataagggcctgagaagagatgaagatgctaaggaaacccagatagctaccaagaagaagctcagggagataagagaaggattgggtggtgatccaggcactatggtggggaaaccggagacaagtagcaagtgaaatttatagagaatttgagatactatgttgggagaatcagaactggattggaggtgaacatagagcagaaattcaggcatcagagaagagagaccaaagaaaggatggatgtgaggatggcacaaatatcctggcacccgaggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagaaccaggaacagggtggaggtgggaatgatgaagaaattcaaatacaggggaagagaaacctgagagggaccacagctgatgatggtacagagacccaggctcctgcaggagatgaccagggacagttaagagttgaaattgctgaagagatccaggtacaagggcaaggaaataagaatgacggtggagttgaggatgttgcagaactccaggatataggaagccagagaaagtgcacagatgaggatgttggagagcctcgagcaccaaggggaggaaacaaggatctggtcagaggagaggatgctgtgagggacagtctccaagtcgactgttctgggagtgagaggcccacaggcaggaagcacagcctaccatggcctccagccttcactggctatggatgtgggacccgggaacaggaacaggcagtggctgtgaatggtttcatctctgccccctgtcctgagatgaatcctgtcccccactggggtgaagtcttcctgctggtgggtggggagggagagcatctggccagccagggcacaacccctgccagggatcatagagtggggatcagtccagcctcccagcaggcccaacctgaatcctggagaagacgacaaagggacaaaggggtggatccagagaaggcccccagcctgactcggcagtcccaaaaccctccgtctctgacagctcccttgggcatgccctctgcctgctcctgtctcccgtgtggcccagccccggaagctgccatcattctagcgggtcctcccaccgccctcactgtcctgcccaaggggacaggcctcaagaagagcaaacgactgctcctggagtccctcatgcggaggaggattgcacacctgaagtggggtcttccccggcggatcctggagtcctatttcctgtttaacttcttaggatcttgctcattgacccttgctggggcgaggctctctggactgaacacaggccaggagctccaagcccagcaggaaaggtattgtgaggcccaaggctccccaccaggccttaagtccccagagaggttccagagggttcagcgcccagacagaaaaagctcgaaacttcctatacaagccagagctctggagaggaacagaccgcacatgtcagagcccattaagcatttccatccagcctgaaaaggccaggagagtcaggccaccagggggcgccagagaaccacaggagatccaggaagcgcttgctaggaccaagctcccagctcccaggacccccaggccggcagcggagtccaggagctggtgtggcccacaaagggtcggagagcctcccagtgagaacagtaggggcaggaaaatgatcaggtcaagggtctcccagctggcagagagggctcccagcagagtgaggacttcattctctagggcagaccacgcccactggaggaaggaatgtacatcctgggaggcctctaagctccccagactcaaatgccagcagctcacatactggagaagaggaagcctggaatctacagggtgcagaggggctgggcagcagccttcctgccattctgcagaacctgtcagcttcaaagggaggctccactctgcggtggcaaagctgggcctgacccttctggccaagatgtcctggtccccacagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggc

SEQ ID NO: 118934 - DNA, 690 bp, Homo sapiens
  Payload ID: 3298
  Gene Symbol: C3orf14
  Gene Name: chromosome 3 open reading frame 14
  Uniprot ID: Q9HBI5
  ENST ID: ENST00000232519
  CDS Start-End: 47-433
ggtgccttcccggaagggctcagaggcgggctcgctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaa

SEQ ID NO: 118935 - DNA, 3525 bp, Homo sapiens
  Payload ID: 3298
  Gene Symbol: C3orf14
  Gene Name: chromosome 3 open reading frame 14
  Uniprot ID: Q9HBI5
  ENST ID: ENST00000494481
  CDS Start-End: 315-701
agaggcgggctcggtgagtggagtcggacagtgggtgggtgccctgactgcctgacggccgcgcagggccttgcaggaccgctggggaggatgttgttaacgtaaagagccaggctgatgaggaaggttcatgagtcctttgggtataagcgggagttggggcggccggagggcagatgactctgagaagggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatggttcttttttttttttaaaccattattgtttcttttaacaaattaaaagacaatgacacctaaactgctctagcaaaataacttatgagaaaataaattcataggattttgtccctcacagatagccaaagctctgcaagttctggagacagaaagaactgaactataaagcagtcaataagtagccagtttcaggaagactcagacttggttttgaaaaaggatgccttttagagctgggaaaggttattggattttgacttggttatttaaagattgccaaccttgtgaatgcaaataaccccactcttgtcttttcatctttaaacttccccttcccgcttccttctaatttcattattcctgaaaaaactgtcagtcagaaagcgttgggtcacaaccctaaacagctttgagattcctcagtccaccactgcttgagcacttaaaaaaaaaaaagaaaaaaaaaatatgtatatataactttccagctatagaggcagcctctgctagtaaagggtacctatgctatattacaatgaaatgttttaaatttcaaactggtttatgtttttaaaagaagacaataggaaaagctaaatacacagcaacaacaacaactatattgaaacgtccgttgtgccgataagttcctttaaactaccatcttggaaatatcctgttgagtgggtgttggtgtgggtaacaataatgttgttttcataatatgtgctggcagattagcacacttctctacagtgttaacagttgtaattaaggaataaacagcacagggtgtcagtccgatgacaatttcatctatagtgtcacaatacaaaatgtcacaaaatattagaactgttatataactataaaaagtatcagcttaaaagctaaaagcctttgaaaaaagaagacagaggaaggaagaaaaaagaaaactggcatagcaaccagaacaattttataccttctcaagaatgttctgtcatgaaaataaattgataatttttttctgttacattacagtttggtttctagccatccagttgatttagcaggagaatgcaggtttttttagcagctttgaattggtaaacagatttagatgtagtagaaaggaacatgaggaagttgtttttttttttaacatccaatctttcccagcatatgcacataagaaggtgaatgaagcaatgtgaaacttacttctctttagtcaagtgaaaaaaaggctaaacatttgttagatggtaaaatattgtgtcaagcgagtaggcaaattccaaaattacacagtggttgatacattaacatcctcaaatatttgagcatgcacttcctttgagatctgtaaattaaatcaccagtgggttagataaaaatacaaaacaaatggcaatctaaccatctcagaaaaggttcaggtttttttctccctaaaactgagaacttgctaaataatttttgaaaagcataaacgtaatacaccctgggttacgatcgagggcagaagggaaggcatttccaaggctcctgctgtagtgtttttcccatttttgttaatacctcaaaaactcccagagatgactttattcctggcccctgcagagctcccctccccacccccaccttgtagactgtaacagattgcaccacatggtgtctgtttaaaaaaaaaaaaaaaattcccatagggacctggatatcccattaatgggctttatgttcctcatggcaaattagctttacacaggaatttccaaacattgttttctgttaagaagggaggaataccatatataatgtatattttttctacaattagtaggaatcagacaaggaaaaggaaatgtcatctattcatacctttctctccaaattcagtgttctttccatatgctccattgtactccaccactcttctccatgaaaactatgaatttatggtttttttttagaaaaatggagttttcaaaatgaaagtcaaataattttttccaaagccgtttgtggactgttgcaaatgcataaatattcaaagctcattttctgcagaaacacttctggtatatgaaattattaaactgtagaatgctaaagatcagaagaagctacagtttttctttaaacttgaaaaaaaattaagaagtattaaggaaaaagcttaatactctggaaaccagacatctggtctttctcatgcgtagggagcagtgtgaatgaaagtgaagtcaaacggacagtttttttctgcattatgcacaaggtgttttaaattgtcagcttaaggtttagatgaagataatctttaactttgtttacaatttttgctattttgcattatccccctttttccataaaaaataaagtgaatatgtgtgcatatttattttgaatcaaaattaaacttattttgagatta

SEQ ID NO: 118936 - DNA, 465 bp, Homo sapiens
  Payload ID: 3298
  Gene Symbol: C3orf14
  Gene Name: chromosome 3 open reading frame 14
  ENST ID: ENST00000465142
  CDS Start-End: 278-465
cggaagggctcagaggcgggctcgtgctgatagtgggcctcacagaaaagttaccatgaaccgactttccgggattcccttggcgctgcattaattggcctcgttgcaaaaggaaaccgagaggaaggcggcaagacttggcctgcgggtgatggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagc

SEQ ID NO: 118937 - DNA, 631 bp, Homo sapiens
  Payload ID: 3298
  Gene Symbol: C3orf14
  Gene Name: chromosome 3 open reading frame 14
  Uniprot ID: Q9HBI5
  ENST ID: ENST00000462069
  CDS Start-End: 208-594
gtgaccacgccctggcctgcgctaaggccccggcgtcggcgcagtagctggtgccttcccggaagggctcagaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataa

SEQ ID NO: 118938 - DNA, 768 bp, Homo sapiens
  Payload ID: 3298
  Gene Symbol: C3orf14
  Gene Name: chromosome 3 open reading frame 14
  Uniprot ID: Q9HBI5
  ENST ID: ENST00000542214
  CDS Start-End: 125-511
ggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcacccacttccacggcctgaggtggtttctcttgagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaa

SEQ ID NO: 118939 - DNA, 4992 bp, Homo sapiens
  Payload ID: 3299
  Gene Symbol: C3orf17
  Gene Name: chromosome 3 open reading frame 17
  Uniprot ID: Q6NW34
  ENST ID: ENST00000314400
  CDS Start-End: 193-1896
aatatacagatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactgg

SEQ ID NO: 118940 - DNA, 4672 bp, Homo sapiens
  Payload ID: 3299
  Gene Symbol: C3orf17
  Gene Name: chromosome 3 open reading frame 17
  Uniprot ID: Q6NW34
  ENST ID: ENST00000383675
  CDS Start-End: 87-1580
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaa

SEQ ID NO: 118941 - DNA, 459 bp, Homo sapiens
  Payload ID: 3299
  Gene Symbol: C3orf17
  Gene Name: chromosome 3 open reading frame 17
  ENST ID: ENST00000472166
  CDS Start-End: 215-459
tttttcctgtacccgaggagcggtggacgtcacctaagcactgggactcaaactgcaatcttttcggacctctatctgcttatctgtgaaatggaacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttt

SEQ ID NO: 118942 - DNA, 1382 bp, Homo sapiens
  Payload ID: 3299
  Gene Symbol: C3orf17
  Gene Name: chromosome 3 open reading frame 17
  ENST ID: ENST00000462295
  CDS Start-End: 20-130
gtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttct

SEQ ID NO: 118943 - DNA, 1817 bp, Homo sapiens
  Payload ID: 3299
  Gene Symbol: C3orf17
  Gene Name: chromosome 3 open reading frame 17
  ENST ID: ENST00000469169
  CDS Start-End: 18-128
aagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctg

SEQ ID NO: 118944 - DNA, 2056 bp, Homo sapiens
  Payload ID: 3299
  Gene Symbol: C3orf17
  Gene Name: chromosome 3 open reading frame 17
  ENST ID: ENST00000473284
  CDS Start-End: 215-325
acgcggccacgtgttggtaaccaatatacagatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctg

SEQ ID NO: 118945 - DNA, 520 bp, Homo sapiens
  Payload ID: 3299
  Gene Symbol: C3orf17
  Gene Name: chromosome 3 open reading frame 17
  ENST ID: ENST00000496340
  CDS Start-End: 25-369
ctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaagtaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatcta

SEQ ID NO: 118946 - DNA, 1048 bp, Homo sapiens
  Payload ID: 3299
  Gene Symbol: C3orf17
  Gene Name: chromosome 3 open reading frame 17
  ENST ID: ENST00000461381
  CDS Start-End: 25-741
ctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctca

SEQ ID NO: 118947 - DNA, 1212 bp, Homo sapiens
  Payload ID: 3299
  Gene Symbol: C3orf17
  Gene Name: chromosome 3 open reading frame 17
  ENST ID: ENST00000472705
  CDS Start-End: 18-137
aagtccccccgcctcgcatgatggctgcggtgccgccgggcctggagccgtggaaccgtgtgagaatccctaaggcggggaaccgcagcgcagtgacagtgcagaaccccggcgcggcccttggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttg

SEQ ID NO: 118948 - DNA, 578 bp, Homo sapiens
  Payload ID: 3299
  Gene Symbol: C3orf17
  Gene Name: chromosome 3 open reading frame 17
  ENST ID: ENST00000491121
  CDS Start-End: 75-185
gtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacaga

SEQ ID NO: 118949 - DNA, 741 bp, Homo sapiens
  Payload ID: 3299
  Gene Symbol: C3orf17
  Gene Name: chromosome 3 open reading frame 17
  ENST ID: ENST00000494164
  CDS Start-End: 205-315
gtgttggtaaccaatatacagatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagag

SEQ ID NO: 118950 - DNA, 947 bp, Homo sapiens
  Payload ID: 3299
  Gene Symbol: C3orf17
  Gene Name: chromosome 3 open reading frame 17
  ENST ID: ENST00000460410
  CDS Start-End: 186-296
agatgactgggtccttcccagtcccacgcgtttactcgatgaaggcagcctcccgccgggctcctggccccgcccgagccccaccccctgctcccttccggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaag

SEQ ID NO: 118951 - DNA, 2179 bp, Homo sapiens
  Payload ID: 3299
  Gene Symbol: C3orf17
  Gene Name: chromosome 3 open reading frame 17
  ENST ID: ENST00000472637
  CDS Start-End: 8-118
gcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaa

SEQ ID NO: 118952 - DNA, 751 bp, Homo sapiens
  Payload ID: 3299
  Gene Symbol: C3orf17
  Gene Name: chromosome 3 open reading frame 17
  ENST ID: ENST00000496206
  CDS Start-End: 1-342
atggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaagtaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaa

SEQ ID NO: 118953 - DNA, 1576 bp, Homo sapiens
  Payload ID: 3299
  Gene Symbol: C3orf17
  Gene Name: chromosome 3 open reading frame 17
  ENST ID: ENST00000489848
  CDS Start-End: 24-134
tttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtca

SEQ ID NO: 118954 - DNA, 545 bp, Homo sapiens
  Payload ID: 3299
  Gene Symbol: C3orf17
  Gene Name: chromosome 3 open reading frame 17
  ENST ID: ENST00000470663
  CDS Start-End: 35-145
gtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatggtatgtacatacctctgacatccttcatttctttctcatctcctttcagcctaggtttcttattagtagttttcaaacttattttcttatggggttatggaaggtgcaggtattctctttcttggtttgatcagagttttttgagggtagattggga

SEQ ID NO: 118955 - DNA, 1512 bp, Homo sapiens
  Payload ID: 3299
  Gene Symbol: C3orf17
  Gene Name: chromosome 3 open reading frame 17
  ENST ID: ENST00000469809
  CDS Start-End: 12-122
ccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagtaagagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggc

SEQ ID NO: 118956 - DNA, 2655 bp, Homo sapiens
  Payload ID: 3300
  Gene Symbol: C3orf18
  Gene Name: chromosome 3 open reading frame 18
  Uniprot ID: Q9UK00
  ENST ID: ENST00000357203
  CDS Start-End: 541-1029
aggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagtttgatcactatgatcatctcacccacagacagaggatgcagggcttcatttttgttcccaaaaacaggggcaccgtagatacgtaaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttta

SEQ ID NO: 118957 - DNA, 2486 bp, Homo sapiens
  Payload ID: 3300
  Gene Symbol: C3orf18
  Gene Name: chromosome 3 open reading frame 18
  Uniprot ID: Q9UK00
  ENST ID: ENST00000426034
  CDS Start-End: 366-854
ggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgtttacatgga

SEQ ID NO: 118958 - DNA, 551 bp, Homo sapiens
  Payload ID: 3300
  Gene Symbol: C3orf18
  Gene Name: chromosome 3 open reading frame 18
  ENST ID: ENST00000422619
  CDS Start-End: 87-419
aaaaaaagaggcatgaaggtgaagggggagtggtgtatgtgtcattaggacggggacccacgggtctcttgttcatcagcctcagcatgtccccatccagaagggctgctgggttcctcagggcctcctctccttgccatttgatgctgctccttctcttgcaggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtccta

SEQ ID NO: 118959 - DNA, 1520 bp, Homo sapiens
  Payload ID: 3300
  Gene Symbol: C3orf18
  Gene Name: chromosome 3 open reading frame 18
  ENST ID: ENST00000430746
  CDS Start-End: 381-695
acccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttgagacggggtgtcagtatgttgcccaggctggacttgaactcctgggctcaagagatcctcctgcctcagcctcttgagtaactgggactacaggcatgtgctaccttaccgggtccctttactttttgcctgcatgtggctttgagcctgggaagagttgaggggagggaatgtgctgaagttttccctttcttcttcagccctggggagccacaggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggg

SEQ ID NO: 118960 - DNA, 2365 bp, Homo sapiens
  Payload ID: 3300
  Gene Symbol: C3orf18
  Gene Name: chromosome 3 open reading frame 18
  Uniprot ID: Q9UK00
  ENST ID: ENST00000449241
  CDS Start-End: 252-740
gaggtcacaagctctggtgccccaaaatggctctggtcctcagatatagttggttgccaccctgggagtgagaggaaccaggaaagcagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttt

SEQ ID NO: 118961 - DNA, 1490 bp, Homo sapiens
  Payload ID: 3300
  Gene Symbol: C3orf18
  Gene Name: chromosome 3 open reading frame 18
  Uniprot ID: Q9UK00
  ENST ID: ENST00000441239
  CDS Start-End: 216-644
accctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaacatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgcgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtg

SEQ ID NO: 118962 - DNA, 3326 bp, Homo sapiens
  Payload ID: 3301
  Gene Symbol: C3orf20
  Gene Name: chromosome 3 open reading frame 20
  Uniprot ID: Q8ND61
  ENST ID: ENST00000253697
  CDS Start-End: 453-3167
agtagagtttagaatttggaacggggatgggtactggtctttacagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagcgaaccagtgaaacatctttttattcttgcaggttcttaatgattgaccacaagcagatctttcaccctcggatctctagctacaaaaggaaccactggctcaatgacctgtaagggccgtttcagcacatccattctgtccatctccaagccttcaccgtagggaagaacttttgctctcagtcacctctcagagagctctctttatagctgaaggtccctctcatgagttacatcaagagtaacctagaattatatcagcaatacacagccatggcccccaagctactggcccgcatctccaaactcctcatgatctgccagaatgcaggcatttctgtaccaaaaggcatcagaaacatctttgagttcacttgggaagagctcatcagtgacccttcagtgcctaccccgtccgacatcttgggcctggaggtcagctttggagcccccctggtggtgctcatggaacccacctttgtgcaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggaca

SEQ ID NO: 118963 - DNA, 2744 bp, Homo sapiens
  Payload ID: 3301
  Gene Symbol: C3orf20
  Gene Name: chromosome 3 open reading frame 20
  Uniprot ID: Q8ND61
  ENST ID: ENST00000412910
  CDS Start-End: 237-2585
gtccttttaagtcagtaaattgaactaagtcggttattcggcaagcagttcctataaaaaactacatggctaaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggaca

SEQ ID NO: 118964 - DNA, 2858 bp, Homo sapiens
  Payload ID: 3301
  Gene Symbol: C3orf20
  Gene Name: chromosome 3 open reading frame 20
  Uniprot ID: Q8ND61
  ENST ID: ENST00000435614
  CDS Start-End: 380-2728
acagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagcgaaccagtgaaacatctttttattcttgcaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctcca

SEQ ID NO: 118965 - DNA, 1000 bp, Homo sapiens
  Payload ID: 3302
  Gene Symbol: C3orf22
  Gene Name: chromosome 3 open reading frame 22
  Uniprot ID: Q8N5N4
  ENST ID: ENST00000318225
  CDS Start-End: 380-805
aagggcttctgaccttgcagtgagcttgttggcactgcctgtccggggaccctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgtagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgagggctcggggctccagattttacatcaccgtctggctcctgcccggcaccactaccagcaccatcaccacctccactgtgcaacctttgggaactcaagttgctgagtcgccgcttccccagacaactcgccttcctgctgtccacccggcacactgaggctgcctgcccccagaccagcaaggcggcagggctgtccaggggcctctcctagagactgggctctgtgtgtggccttcttattggccaccttctccttggcaggctctgggcagtagccacagagactttagtaaagggatcagccttcatggccatcatagaccgggagtggtttgtggtccccccaaaaagctacaccaagctaataaactgcgagttcccaccccacttccagctggaatgatca

SEQ ID NO: 118966 - DNA, 1781 bp, Homo sapiens
  Payload ID: 3302
  Gene Symbol: C3orf22
  Gene Name: chromosome 3 open reading frame 22
  Uniprot ID: Q8N5N4
  ENST ID: ENST00000505070
  CDS Start-End: 380-688
aagggcttctgaccttgcagtgagcttgttggcactgcctgtccggggaccctggggctgctgttcctgtggtaatgtggcagctgggaccatggccagcttcagtctgcctggcgtcacataagccagcccacagggtcctgcagcttgtcctttctggctggaagctctgggcatagcctgggactgggtctttccagagagggctgtagccagggccctgccagcctcgggggccacagcggctctcacaccagcatcttgctggataggagcagttccaggactctctgatcacacctgatcatcgtcactgccagaattcaaggtagctgcctgccatggctgagaggtgtgcctcagcttaacccactcagtgatggactccagtgcctgcaagaagtctcaccagagtaagaagtggaggatccaggcccaggagaattttgccaagaagtttccgtacaggttgtcgtggctgacagagcccgaccctgagcccctgcagccctgggaggtcacaaacgactcgaacacggtgcagctgcccctgcagaagaggttggtgccaacgaggtccatcccagtccgaggggttggtgtgaggattaaaaagagcatgaatgtcacttctaggactttatcccaaatgtacactcacacaggcaagtgggccccatttcactgacccatgaggaaataccagcccagggaaggagagcagagagagctgctcaaggccatgcgattgctgcacacaggacacccgcacacgtcatgttgcaaggcctcctctgccaatcaagataccgggtgaaacaccacactagaaacctacagcagaagcacgaccatcctcctctgcacacccacctcagccaaagcagggctcgcgccctgtgcagggattgccaattcctgttctgcagagccacccacctgccagcttgcctcttctcacggtactttctggaggtcctctgaactcgggacactccagcagtacctgaagatggacagcagcatggggagcatctaccaatttggctccagcagccacttcccctccctttgcccacccaccagaggaggatgcctgccaggccttcagcccatgtgattccgataggctcccctacgcctccaccacctgctgggataggcatgtggcctaggcctgtccaatcacagcctcccagcccttcctgccacctgactggctcagagacgggcacttgagacccagaccgggccaatggatgcctccttgggactttggctggaatcagtggcaaaggaaccctctctagctttgggttggagttgctgaactggtgcagctgagagtgaggctatggcagagaaaagctaaaccacagctggaggtgtgatctgaaccccaagatctatgcctgtccgaggcagaggcacctggccttttcagtcacaggcacagacccactccctcccagctgaagggagtctgaattgggttgggtttgtcctcgccgaggctaccactgtgtgccattgggtggcccacagtcttagcttccttgcctgcctaggggtgagcaggggctgggatgggatgcagaggcccacctggctccaagaggaacacctgtgactccaaacactgggacagatgctcagccctgcagccgcgggagtggaataggggaagggggctggtgccaacactgctcccgccggtgtctcagaggcagaagacatagagctgagatcttgggttttcatattaaaaatgtaagctcctc

SEQ ID NO: 118967 - DNA, 1814 bp, Homo sapiens
  Payload ID: 3303
  Gene Symbol: C3orf30
  Gene Name: chromosome 3 open reading frame 30
  Uniprot ID: Q96M34
  ENST ID: ENST00000295622
  CDS Start-End: 41-1651
agtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctgatgaattttcagaaattgaccaaggaaagggttatcatatacgcaatcaaacttatagaaggttcccttctatagtttatgaagatccttaccaagtttcactccaatacatggaaaaacaccacattctgcaaatattccagcagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtacgtacaactctgaattcttatgaagtaaacatacctgtaactaccattcaagtttttaaaaaataaataaaacataaccagc

SEQ ID NO: 118968 - DNA, 1438 bp, Homo sapiens
  Payload ID: 3303
  Gene Symbol: C3orf30
  Gene Name: chromosome 3 open reading frame 30
  ENST ID: ENST00000460150
  CDS Start-End: 1-1324
ccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctgtgcaggaaatgatgaaaaagagagacaaaatgtgaaatctacaaagaacgagcctctcttcagtattgtttacaatcatgtgtcaatactatgttctgttttccatctgaaaaaaaaatggttttgaatagacattagtggtgactcta

SEQ ID NO: 118969 - DNA, 688 bp, Homo sapiens
  Payload ID: 3303
  Gene Symbol: C3orf30
  Gene Name: chromosome 3 open reading frame 30
  ENST ID: ENST00000492792
  CDS Start-End: 1-667
taggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctattactgaaaacttagtctatgaaaagccagaggaccccctgaattttatgctgtgccaggtatagaattggagaaaaagaacaacc

SEQ ID NO: 118970 - DNA, 1072 bp, Homo sapiens
  Payload ID: 3303
  Gene Symbol: C3orf30
  Gene Name: chromosome 3 open reading frame 30
  ENST ID: ENST00000473121
  CDS Start-End: 1-862
gcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatcttttatgaagatccttaccaagtttcactccaatacatggaaaaacaccacattctgcaaatattccagcagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtacgtacaactctgaattcttatgaagtaaacatacctgtaactaccattcaagtttttaaaaaataaataaaacataacc

SEQ ID NO: 118971 - DNA, 1858 bp, Homo sapiens
  Payload ID: 3303
  Gene Symbol: C3orf30
  Gene Name: chromosome 3 open reading frame 30
  ENST ID: ENST00000494105
  CDS Start-End: 40-1647
gtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatctcatccaaattgaactataccagcagtcaagaaaaaactcaagccatagtaaccaaatctgatgaattttcagaaattgaccaaggaaagggttatcatatacgcaatcaaacttatagaaggttcccttctatagtttatgaagatccttaccaagtttcactccaatacatggaaaaacaccacattctgcaaatattccagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtgcaggaaatgatgaaaaagagagacaaaatgtgaaatctacaaagaacgagcctctcttcagtattgtttacaatcatgtgtcaatactatgttctgttttccatctgaaaaaaaaatggttttgaataga

SEQ ID NO: 118972 - DNA, 1884 bp, Homo sapiens
  Payload ID: 3304
  Gene Symbol: C3orf33
  Gene Name: chromosome 3 open reading frame 33
  Uniprot ID: Q6P1S2
  ENST ID: ENST00000340171
  CDS Start-End: 100-984
cggtccgcggggaaggggaccccgccgccttcccgaggtgagcggcgccccctgccgccagccggaggagctcagggccgctcgcaggaggccgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgcttta

SEQ ID NO: 118973 - DNA, 864 bp, Homo sapiens
  Payload ID: 3304
  Gene Symbol: C3orf33
  Gene Name: chromosome 3 open reading frame 33
  ENST ID: ENST00000486435
  CDS Start-End: 1-347
tggcggggcagcccgcggccaccggctcgccgtctgccgacaaggacggaatggagcccaacgtcgtggctcggatctcgcagtgggcagacgaccacctgcgcctagtccggggacacggtattcctctctggcccaagctggagtgcagtggcacgatcatagctcactgctgctgctccacccacttcggccgaaaagatcctcccacttcagcctcccgagtagctggaaccacagaccaagtcttgcacttgtcccccaggctggagtgcaatggtgtgatctcggctcactgcaacctctgcctcccaggttcaagtgattgtcctgcctcaccctcctgagtagctgggattacagaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaa

SEQ ID NO: 118974 - DNA, 1926 bp, Homo sapiens
  Payload ID: 3304
  Gene Symbol: C3orf33
  Gene Name: chromosome 3 open reading frame 33
  ENST ID: ENST00000482061
  CDS Start-End: 15-374
aggaggccgggaacatggcggggcagcccgcggccaccggctcgccgtctgccgacaaggacggaatggagcccaacgtcgtggctcggatctcgcagtgggcagacgaccacctgcgcctagtccggggacacggtattcctctctggcccaagctggagtgcagtggcacgatcatagctcactgctgctgctccacccacttcggccgaaaagatcctcccacttcagcctcccgagtagctggaaccacagaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgcttta

SEQ ID NO: 118975 - DNA, 733 bp, Homo sapiens
  Payload ID: 3304
  Gene Symbol: C3orf33
  Gene Name: chromosome 3 open reading frame 33
  ENST ID: ENST00000465810
  CDS Start-End: 8-223
cgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgta

SEQ ID NO: 118976 - DNA, 1804 bp, Homo sapiens
  Payload ID: 3304
  Gene Symbol: C3orf33
  Gene Name: chromosome 3 open reading frame 33
  Uniprot ID: Q6P1S2
  ENST ID: ENST00000534941
  CDS Start-End: 150-905
gctcgcaggaggccgggaacatggcggggcagcccgcggccaccggctcgccgtctgccgacaaggacggaatggagcccaacgtcgtggctcggatctcgcagtgggcagacgaccacctgcgcctagtccggaacatcagcactggaatggccatagctggaataatgttacttttgagaagcattcgactgacatcaaaatttacaagctcttcggatattccagtagaatttataagaagaaatgttaaactacgtggacgattacgccgaataactgagaatggtttagaaattgaacatatacctattactttacctattatagcttcattgagaaaagagccacgtggtgctttgctggttaagttggctggagtagaactcgctgaaactgggaaggcatggttacaaaaagagctaaaaccttcccaattactatggttccaacttcttggaaaggagaattcagcactcttttgctatcttctggtgagtaagggtggatatttcagcgtgaatctgaatgaagaaattttgagaagaggccttggcaaaactgttcttgttaaagggcttaaatatgattctaaaatctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctggattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgcttt

SEQ ID NO: 118977 - DNA, 1668 bp, Homo sapiens
  Payload ID: 3305
  Gene Symbol: C3orf36
  Gene Name: chromosome 3 open reading frame 36
  Uniprot ID: Q3SXR2
  ENST ID: ENST00000408895
  CDS Start-End: 1010-1507
tgatggatggggcaggggaagaaagtcctggaagatcccgcactgctaagcaatgctttgtcccaaagtaacgctcttcactctgctcccagcctagctgccgcaagagcggaacagaatattctgtgtgctcaggagaagaaaagagcagatatggttgagcactaaaaccctctactgtgggtagtgaacctaggtggacacagttgctcaccgggacacttaaaccagctttgcggggctgtcggggttgggaagcacagtctggaaagatttcccaatggaggaagcaccaattgtgggtccctgaagctgaggggatgatgcccaggcaaggccgaggcagtctgcagagggctggggaggtgggaaagacgattttgctcagaggaggcagagatggggtggtggctgagagagatgcagggtcaaggaaaggatggcttcagagaggagagatttgctggggcaaaaggccacaggatggggaggctgcggggtccaagaggacagctgatggagcgagaccctgcaggcaaggaggagatggggtgactcatggcagaatcgcaccagagttcccacagccctgtgcggccactatgactagtcccatcctgtacatggagaaaacgaggctccttccagttgtccctcacgcctcccttgatttatgtactacctgatgtgtataaggacaggtggtgacaaacacatggtccctacccttcaaggacatataatccagagctaagacaagaccttaacacagggcaaagtactatgctctgagttcatttgatgagcgatgggagaacgggcttgatcctagccatgcgggagagactggaattcaagagagtcaaatgtgctgggaaagactttctgggcaaaaggaataagcaaaggtgtgcaaaggtaaggaagcaggaaacctttgcacatcttgagaactcgccggccagaggcctgtgaaggagcgcagtggtcaggcaggagaggcagtcggatgcaggctgagaccatcctggagggtcttgaggctggcttaccccaggctgtgagtagtgggctcagcctagtcccggctcctgggttagtgctcacgtgtctctctgccccctcagggcctggaggaatggccttagagcccccaccaaccacgctcaggaaggcattcctagctcagagtaccctcctggagtctacactggaaggggctcctgagtgggccgcgccacaccccgaggagcagaggcgcagtcctcccgcgtgctcccagcacactccacccctacccagcacacccacggggcccccaccttgctcacctggggggaaccacccactctgcgccctctcagggagaggtggtggccgctgctctatcccctccctctcttcctcttccaccttctctctcttctcatctgggtgctggaacccaagggtgaaactgagagtcagaaagtctcagtctcaaggcagagcggggcaactaatttaaaacggcttctactccggcccccagtgtgactaatctccttctcttcgctccacaggtctataaatgggccacagtaggcacccctttttaaatctgtaaaatccccaaatccattaaaagtgacttcagaggtcccagatagggaccaacatttgtttaaa

SEQ ID NO: 118978 - DNA, 2633 bp, Homo sapiens
  Payload ID: 3306
  Gene Symbol: C3orf38
  Gene Name: chromosome 3 open reading frame 38
  Uniprot ID: Q5JPI3
  ENST ID: ENST00000318887
  CDS Start-End: 311-1300
tggaggagggacttctctttcggtaaccagctcccttgcggatagtctatgttctccatataaacccagcacttcccttaattgagatacgtgggacttcactccgtccccagcccggaaccacaagtgagggcactgcgtttcctgattgacctctttggcgattacttccgcccaggggcctggaatactggaggcccttcgacggagaacaacaagaaaggcacttccggtgtctgttgccaggcgcgggcccagtgggccgtaggggcgacattgttgccgttgtctttcccccccagtcccggggatggagatgtcgggactcagcttttcagagatggagggctgccgtaacctacttggcctactggacaacgacgagatcatggccctatgcgacactgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaaacgccagagccagttacaaagacagaggacatccacctatttcaacagcaggtgaaagaagataaaaaagctgaaaaagttgattttcgtcgcctaggagaagaattctgtcattggttctttggacttcttaattctcagaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaaccaggtaatattttccttttacttagtgaatattctgctaatatctgcacttttcatgtgggaaaggattaataatggtccaggcttcccctctttaagtttcatgtttacttttgtctaactctggataattgtattttacaaatgcatctcactgtagtatatttttaaaactattaaatattttagagatgtttaacgtaaactcaaagttctcattttagaaaatttaaataacattctttttgcaaaaaagtccaataatttaacagttgaagaaaaacttactacctctttaaagatttgagaaacatttttcaaagttatcagctgtagtccaagctaaatatcttttgtaatctgcaacattttccttactgtttttgggcagtgataaatgctgttctcgaaatagactttattcttacctaggcttcagacaacagttttatagagcagttactgtaatacaatataaaggaaatatgctgttgaaattttaaaggtatgcccagttcctaacttttaaacgaattaccgttcttcctcttggctgatcttggcagagatgacaaaaaaaaccccaaaacaacccatgcatgtataatgtgtgtatacacatatacataagtatacatatactcccacattataacttagaatatttagttttttacctgttactaggtttgagttacatggttgagttgccaaattatttacatgctttgtttaaattcttcatcacctagcaactgtttgctgatcatggatttacttagttactttaatttataaaattaccatttggaaaagaactcaattgggaaatgtgatgacgtattgtacatgttactttttcctttgctataatcatctagggagactgataagaattttggaaatgggagcctggaaactcatctttgtttttttaatgctatgcctcttacgaggaatacgaattggtatgtcctaaaataagaacttaataaaggagggaaatcccttttgtctgctataagaa

SEQ ID NO: 118979 - DNA, 1259 bp, Homo sapiens
  Payload ID: 3306
  Gene Symbol: C3orf38
  Gene Name: chromosome 3 open reading frame 38
  ENST ID: ENST00000486971
  CDS Start-End: 67-489
aggcgcgggcccagtgggccgtaggggcgacattgttgccgttgtctttcccccccagtcccggggatggagatgtcgggactcagcttttcagagatggagggctgccgtaacctacttggcctactggacaacgacgagatcatggccctatgcgacactgtcaccaaccgcctggtgcagcctcaggaccgccaagatgctgttcatgcaatattagcatacagtcaaagtgcagaagaacttctgaggcgtagaaaagtccaccgagaagttatatttaagtacttggcaacacaggggattgttatacctccagctactgaaaaacacaatcttattcagcatgcaaaagattactggcaaaagcaaccacaactgaaattgaaggaaacgccagagccagttacaaagacagaggacatccacctatttcaacaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaatacttacctatttctacccgagttgcagcaagtattctgaaagcttaatgcaaataaatcccactttagatcttacagctaactgtgtgccttagaaacca

SEQ ID NO: 118980 - DNA, 1292 bp, Homo sapiens
  Payload ID: 3307
  Gene Symbol: C3orf49
  Gene Name: chromosome 3 open reading frame 49
  Uniprot ID: Q96BT1
  ENST ID: ENST00000295896
  CDS Start-End: 111-989
tagcccacaccttgacagtacattcagtcactggatgattttgtattgaagtctgtaagttcaagaactaaaacaatccaaaacggctactacaggtgaagttgagagcaatggcccaacctcagctgtatctaccagaaccctttaagattgcctacagaaaagttggacagtgccgaagattccagcaactcaagaagaaaaatggctcattcaaaaggaaggggatagaaagatggcatagagctgtgtctaccaacttactaaaacaaaatgtattggtccctaaagaggaatcatccagtgatagtgacatgggatttcatgaaagccagcaaaatcagaaaagtaatttgaagacgaaagtgaagactgcttttgggaggatgctgtcctacaagtatagaagcaagccagcatgtgccagccaagagggctccactgaccataaagaagccctcctgtcaaacacgcagagccttctccctaggattgtcaaggagttttcatctcccaagttatttacagcaaaaatgagaaagctctcagagaatgcgactatacaacttgatgttgtagaggcagagacagaggagataacccagggaaacacactccttcgggccaggagaaccaccaagcggttatctgtgacatctcttccttcaggactgcaaaaggggccatattcaccaaaaaagagaccacactttccagcacttaaaaaaaagaagcgtggcatggaaaacatccttcgaaaatcagatttgacagtaggaaagcttcaaatgcaggtggatgacctcatagaaacagtgactgataaatccatgaagctactggcccaaagacatgctgagcttcaacagtgtgagtttctgggggatgaaattcttcagtcttctaaacagttccagaggatatccaagagaaccatgaggaagtataaattaaaaaatatgaccacaaaaggacctggagacagctgacctgagactccttgaggaacacaggaaaaggtcttcagacaataacttaaccaattaccaatcagaaaatcgactccacctatgagctggaagtccttcccaccccccaccttcaagctgtcctgcttttctgtactgaaccaatatacatcttacgtgtattcattgatgtctgcctgtaacttctgtccccctaaaatgcataaaatcagctgtaattcaaccaccttcggcacatctcaggacctcctgatgctgtggcatgtctttaaccttggcaaaataaactcctaaattgattaa

SEQ ID NO: 118981 - DNA, 876 bp, Homo sapiens
  Payload ID: 3307
  Gene Symbol: C3orf49
  Gene Name: chromosome 3 open reading frame 49
  ENST ID: ENST00000616659
  CDS Start-End: 1-876
atggcccaacctcagctgtatctaccagaaccctttaagattgcctacagaaaagttggacagtgccgaagattccagcaactcaagaagaaaaatggctcattcaaaaggaaggggatagaaagatggcatagagctgtgtctaccaacttactaaaacaaaatgtattggtccctaaagaggaatcatccagtgatagtgacatgggatttcatgaaagccagcaaaatcagaaaagtaatttgaagacgaaagtgaagactgcttttgggaggatgctgtcctacaagtatagaagcaagccagcatgtgccagccaagagggctccactgaccataaagaagccctcctgtcaaacacgcagagccttctccctaggattgtcaaggagttttcatctcccaagttatttacagcaaaaatgagaaagctctcagagaatgcgactatacaacttgatgttgtagaggcagagacagaggagataacccagggaaacacactccttcgggccaggagaaccaccaagcggttatctgtgacatctcttccttcaggactgcaaaaggggccatattcaccaaaaaagagaccacactttccagcacttaaaaaaaagaagcgtggcatggaaaacatccttcgaaaatcagatttgacagtaggaaagcttcaaatgcaggtggatgacctcatagaaacagtgactgataaatccatgaagctactggcccaaagacatgctgagcttcaacagtgtgagtttctgggggatgaaattcttcagtcttctaaacagttccagaggatatccaagagaaccatgaggaagtataaattaaaaaatatgactacaactgagcctggaacctct

SEQ ID NO: 118982 - DNA, 2277 bp, Homo sapiens
  Payload ID: 3308
  Gene Symbol: C3orf52
  Gene Name: chromosome 3 open reading frame 52
  Uniprot ID: Q5BVD1
  ENST ID: ENST00000264848
  CDS Start-End: 60-713
gctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggctcacagatgtgtacagtacatcgccctctctgggtcgttattttacttcagttgaaatagtggacttcagtggtgaaaatgccacagtaacgtatgacctgcaatttggggttccatcagatgatgaaaattttatgaagtatatgatgagtgaggagttggtgctgggcattttgctacaggatttccgtgatcagaatatacctggttgtgagagtctggggcttgatccaacatccctcttgctctatgaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctcccccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatttggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttctgcatgttaaatgtgaaccttagtgtatttgtattttgtagaaaataatgaaaaattttaatggagaatgatttaaaaacatttacaatacattatttttgcatctgt

SEQ ID NO: 118983 - DNA, 2054 bp, Homo sapiens
  Payload ID: 3308
  Gene Symbol: C3orf52
  Gene Name: chromosome 3 open reading frame 52
  Uniprot ID: Q5BVD1
  ENST ID: ENST00000431717
  CDS Start-End: 74-826
gaggcggggaggtcgctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctcccccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatttggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttctgcatgttaaatgtgaaccttagtgtatttgtattttgtagaaaataatgaaaaattttaatggagaatgatttaaaaacatttacaatacattatttttgcatctgtgttgttgcattcccat

SEQ ID NO: 118984 - DNA, 965 bp, Homo sapiens
  Payload ID: 3308
  Gene Symbol: C3orf52
  Gene Name: chromosome 3 open reading frame 52
  ENST ID: ENST00000484828
  CDS Start-End: 1-724
agacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctcccccccaccattcgatttgatctacctctaagccaggctgtgaagaa

SEQ ID NO: 118985 - DNA, 1080 bp, Homo sapiens
  Payload ID: 3308
  Gene Symbol: C3orf52
  Gene Name: chromosome 3 open reading frame 52
  Uniprot ID: Q5BVD1
  ENST ID: ENST00000480282
  CDS Start-End: 74-517
gaggcggggaggtcgctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaagggaagtaggactgaagccgaatcctgaagcactggtgggatttgaataagaagatttgccttcctttacacatgttcgtgtcttcttaggatgaggatgaagatgatactatcaaattcctaatcaggaaaaaagctttctgctgtgttcccagcaaaggaaaaatgtttcctcactctcaattctggtaatttccttggttcccttgtaatgaagaacacgtaagtgttatccccaggaaatcaaggtacaagtgtatggaaattttacaaatcatttttttcaggtatgggttaggcaatatcagtattttactatattctgaatttctccaatttacagtatattgcaattgtttgctcacttgtctatattctacactagaatgtgagcttcacaaagctggggaccatattgatcttgttcatcgtggtatgtatttccagtctatgacacaacatctggcacacagtaaatgggttttcaaaaaatatttgatgaagatatgaatacagaatgaatagccaaggacaggacaaccctggtgcaggaggtcagcaaatctaccaccttgactccaacgatatagttaaataacaggacttctctctc

SEQ ID NO: 118986 - DNA, 4346 bp, Homo sapiens
  Payload ID: 3309
  Gene Symbol: C3orf58
  Gene Name: chromosome 3 open reading frame 58
  Uniprot ID: Q8NDZ4
  ENST ID: ENST00000315691
  CDS Start-End: 536-1828
cttggtctcaggagagccagcgcgcacaagcaagggtgtgcggctctgagacgtgcgttgctgcttgtgggtgtgagacatcctagctcctcttccccttccgtgagtccctcctttcctcgcagaccccacttgtcgtggctggctgccgccgcagctcttgtgcgaagccagcagtgcgcgtgcgcgcgggcacgggcgcgcgaccgtcgggtccccgcgctccctccccctcccgctcctctataacttggctggcgtggaggaggcgccgccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatacttta

SEQ ID NO: 118987 - DNA, 3260 bp, Homo sapiens
  Payload ID: 3309
  Gene Symbol: C3orf58
  Gene Name: chromosome 3 open reading frame 58
  ENST ID: ENST00000441925
  CDS Start-End: 156-734
aaacaggaaaagtaaggcagcgttggacttggggctgggagggcttaaggccagacagacgttttcatcctgatcctgtgacctgccctattcatctgagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaagaatcac

SEQ ID NO: 118988 - DNA, 1876 bp, Homo sapiens
  Payload ID: 3309
  Gene Symbol: C3orf58
  Gene Name: chromosome 3 open reading frame 58
  Uniprot ID: Q8NDZ4
  ENST ID: ENST00000495414
  CDS Start-End: 453-1118
agttcggactcggccgggctgggccaggctgcaggcgtgggaaggggcgtctccgggggagccccggggctgtgcagggaggccgagggcgaccccgctgatggagagtctgctcttgttacctagattcgggcgcatttcggatttgactgtggatctttcaacgccagagggagtgcgtctcttaacactccccaaaatgtctctactgcgagtttccttccgctctctaccctgcctttctgcttttatctgccggggcttgcaggtccgcggcgcagactgttcacgagcccttggacctttcctagttcttctgaagtgttctacaccgcgttcgctcttccttttctggcgctggtggctggcctaacttcggtctcagagtctttgttttcgctcatttacctggcagtcatttggacacctaattcgaggacaagttggggaggatgaagtcggagaacgggacagtggtcgggagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgc

SEQ ID NO: 118989 - DNA, 730 bp, Homo sapiens
  Payload ID: 3309
  Gene Symbol: C3orf58
  Gene Name: chromosome 3 open reading frame 58
  ENST ID: ENST00000492452
  CDS Start-End: 92-730
tcggccgggctgggccaggctgcaggcgtgggaaggggcgtctccgggggagccccggggctgtgcagggaggccgagggcgaccccgctgatggagagtctgctcttgttacctagattcgggcgcatttcggatttgactgtggatctttcaacgccagagggaagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaag

SEQ ID NO: 118990 - DNA, 4235 bp, Homo sapiens
  Payload ID: 3310
  Gene Symbol: C3orf62
  Gene Name: chromosome 3 open reading frame 62
  Uniprot ID: Q6ZUJ4
  ENST ID: ENST00000343010
  CDS Start-End: 1038-1841
gttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtgccggtagggccagcggcctgggagccgcggtggggcgggaggcagcggcggggcgggccaggaagctgtgggaagtggggcggggcgtctttggggcttctggcagatggcgggttcctccgcgagagccgagaaccgcctactccaggaggaaagcccgagggttgtgggtcctgctatagccagggccaagctccaggaaatcgtggccattcaggggtagtttgcagcctcatttgtaacattattgtgttgtcctgtgcatttccaatgcattacataaagacatggtcgcttttaggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggaaagatatggagagagatttgaaggctgactcaaacatgccactcaacaattctagccaagaggtcacaaaggatctgcttgatatgattgaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgtcttttaaataccaaattgagtaaggacagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctgctgtgtctcttagtgttcttttccacgggcccctaaaaaagtacaggagtggccaggcacagtggctcacgtctgtaatcccagcactttgggaggccaaggcgagtggatcacttgaggttaggagtttgagaccagcctggccaacatggcgaaaccccatctccactaaaaatacaaaaattagccaggagtggtggtgtgcacctgtagtcccagctactttggaggctgaggtaggagaattgcttgaacctggaggcggaggttgcaatgagccgagatggcaccgctcccctccatcctgagtgacagagcaagactctgtctcaaaaaaataataatttagctggtcatggtggttcgtgcctgtagttccagctacttgggtagggactgaggcgaaaggatcacttgaggccaggaggcagagattgcagtgagctgagatcacgccactgcactccagcatgagtgacagagtgagaccctgtctcaaaaaaaaaaagaaaaaaaaagggaagaaaggaaactgaatctcagggaagtgcccacctcctgagctaataagaggaaggaatatgggggtgaggcagagctggcaaaaggctgttttttgttttgattgtttttaaagaccaagtgaagtatagtataagaagtggggaaggagtggaacaaggagttagatctgtaactgtgagtagtcaattgagataactcaatacctttggacctgattgtttttaaagactgagggtagtataagaagaggggaaggagtagaacaaggagttagatctgaaactgtgagtagtcgattgagataactcactacctttggaccagccagggctgtttataagtgctaaagcccgaacaaaccaaagagttggggagaaaggcctaactaacagctgagtgattgtctaacagactgtcttttaggccagtgactctggcatagggcaggctgcatagccagcaacatcccttaccacaggtctagtgattcctctgggctcaaatgtggaggctacacacccactccttagcagaggttggcctggcacctgctggtgccccaagaactatggcatggttagaccctggccacttgattgcatgtgcctccccagtgggcgtgccctggttcccaaccagttgtggccactgccactgccctgcctggggcaggagttgaggttaaggctaactacaggctccttccaggccacctaccactcagaccctgcaggaggtagcacaaagcattcacagcctgtggagtcagaggccaatttcttctccctgagcaagaagaatggaagcaaatgaaaagtgctcacagtatgctcaactgcccctgctcaggtgaagaatagcctgtctggatggagagatgtcaggctacttgatactcagaaaaacaggtctcaaaacagtgccttccaaataatacatgtggatgtggacactcttctatagacgaggtggagcttaattcctgtccttacccccatattcccacctcattaccaccctttgaaggtgaactagacttaatgatacttcccacgactaaagtagggaaagggaaaagtcacaaacttatagtggggaagcctggcagacacctaaccaagtgatgtcatgtatatgtcatgagaggggtgcatcacttccctggtattcctaccaaaaacccaaattcccagtgtatgatcttgagacaaatgttagacaaatccagacgtggggtacattctacaagatacctggccagaactcaagactgttgagatggccgggtgcagtggctcatgcctataatccccgacactttgggaggctgaggcgggcagatcacttgaggtcagaagttcgagaccagcctggcaaacatggtgaaaccccatctctgctaaaaatacaaaaattagccaggcatcatggcatgtgcctttagtcatagctacacaggaggctgaggcaggagaattgcttgaacccaggaggtggaggttgcagtgagccaagatcgcatcactgcactccagcctgggcaacaagcaagactccacctc

SEQ ID NO: 118991 - DNA, 602 bp, Homo sapiens
  Payload ID: 3310
  Gene Symbol: C3orf62
  Gene Name: chromosome 3 open reading frame 62
  ENST ID: ENST00000424960
  CDS Start-End: 1-297
ggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggaaagatatggagagagatttgaaggctgactcaaacatgccactcaacaattctagccaagaggtcacaaaggatctgcttgatatgattgaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgt

SEQ ID NO: 118992 - DNA, 581 bp, Homo sapiens
  Payload ID: 3310
  Gene Symbol: C3orf62
  Gene Name: chromosome 3 open reading frame 62
  ENST ID: ENST00000436325
  CDS Start-End: 10-581
gaccgttggatgggtcggcgtcactgcgctgcgggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggaaagatatggagagagatttgaaggctgactcaaacatgccactcaacaattctagccaagaggtcacaaaggatctgcttgatatgattgaccatacaagcatccgaactattgaagaattggctggaaa

SEQ ID NO: 118993 - DNA, 2650 bp, Homo sapiens
  Payload ID: 3311
  Gene Symbol: C3orf67
  Gene Name: chromosome 3 open reading frame 67
  Uniprot ID: Q6ZVT6
  ENST ID: ENST00000295966
  CDS Start-End: 505-2196
gggaaccaatgggcgcggccggaacgcgggtggcgctcggcgctgctctttcgcggtttgattctggggtggggcggcagcgggagcgcgcccgcttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaata

SEQ ID NO: 118994 - DNA, 2617 bp, Homo sapiens
  Payload ID: 3311
  Gene Symbol: C3orf67
  Gene Name: chromosome 3 open reading frame 67
  Uniprot ID: Q6ZVT6
  ENST ID: ENST00000482387
  CDS Start-End: 98-2167
aattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaag

SEQ ID NO: 118995 - DNA, 4108 bp, Homo sapiens
  Payload ID: 3311
  Gene Symbol: C3orf67
  Gene Name: chromosome 3 open reading frame 67
  ENST ID: ENST00000472469
  CDS Start-End: 840-1844
ggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaattctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggtacactgcttgataagtgaagtagtcttgaagcacagttgtttccttagctccaataagcactaaaacaagttgaaatgaaagagggaaaatcaactgctatttataaaaatgcaacagattgccatgtcagtccacagttgcatcaggttgttatggtaactttaaactgtctttttttttttttaattaacagtcagccaatttcacttttacttatagaaaccagttttgggtttctttctgttttttcattttaatctttgaatcacaggatgagaaacgatatgcagtttagtgctatgatagcaagaccagtaaaacactgagaatatactgttctagatctctggagaaattgtgttgcagttgctaagcattctaaattgatggttttctggcttccttactcccctgccatcttttcaccttagacctattaggactcattattttccatatggtcccagaatttgaagagttgtgccaattaaagtttagataatgagtcgtggattagtgctgggacttgccttacaggagattttctgtttgcaattatttagaatatggatatatcctataaattagcaaattcgtaaaaagttttaaaatgtttcaaatcaaactgaatataatttggaaatatttgtttaaaacctaatacattgataactttttccccataggaagtgcatttagtcgtggattttcttcagcattatttttaacgatggtcattcatactttctggaaaaatttattctaaaagcagaatacgaacaactttagggttagtgaaaatgtacaaagcttttctatatagaaattatagaaataactagaaaacctttttatatgtgcccacaaaatatttttataacgtaactgattaagaatcctttttggacagtgaggcacagattaagtccatagcaccaaccttcggaggcagttgagaatatagtgggattgtttaagcagtaattctgggttttttcaacttttaatgagtttcttcagcaaagcgcgtagaggatcgtcttttcacaatattcttgcttctgagtgtcatgaaacaattagtcataccaaacataacctactgcaaatccttttatacataaatagtgcatttgatgctagcattttaagtgttgctgctggacacatttgttcctttcacctttaataacataaagctataaaaacatggacatttgtcttcagcacctaatagtgtcctcatcccagctgataatccttccatggtctaaactggctgattaattcagttcattttatgaatagaatagactcatccccttcccatatgcacagcacaatctctcttactaatgcaaaagcattactctaatagtgggcatttcatggtaggtgggaaatggtagttctctggaaaactatgagagaagtattatggataatctgccctttaaatacaccacatgaagaacttacctcttccatctataggaaggctaagcctttagaagaaacagtagagcttcatgggaaaatgaagaatactagctctgaatattttaatttgatatcacttaatgctttcttttgctgtagctactctgcctctgacatccttcaacgtttattatgcagatgtgtatttgttaccaactacataaaattgaaaacaaatttatcatgcattacccaagctttcactggcagggctatctggtcacccctgtgccatgcccatcaaggtgaccagtagcatacggctagagtctgtggtgagaccatcccattgccaacactggcactcaccaccctttaatcagagcctactaagagtggcagccagagagaggggaaacacctgccacattatcaagctttggggtttgctggtacagagactaacgagatacaagctaagatacaaaaataggaccaacaaaaatgctaggctatatttaaacaagttttagcatgtgtaatgataccttcttaacaaaattggattttttcttttgtacttttggtaatttcttttcctgtaggatagcttcttctatttattaattgtataaatcaatgggaaattaggctacatatttacaatgtttatttacatatagtctttgaagaaaaatcagtttagttaattaaggcatccttactattaattgcattattttagaatgttacatccttatctttgtataattatacttcaggaaaacataatgtcaagttgtaaataatggtggacaagtgaataacaattatattattatgcttgaagtttataaagtgtaattaaaagactttatttgatgtta

SEQ ID NO: 118996 - DNA, 917 bp, Homo sapiens
  Payload ID: 3311
  Gene Symbol: C3orf67
  Gene Name: chromosome 3 open reading frame 67
  ENST ID: ENST00000471288
  CDS Start-End: 420-917
gctcggcgctgctctttcgcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagcta

SEQ ID NO: 118997 - DNA, 428 bp, Homo sapiens
  Payload ID: 3311
  Gene Symbol: C3orf67
  Gene Name: chromosome 3 open reading frame 67
  ENST ID: ENST00000495572
  CDS Start-End: 1-123
agcataagtaccagcagtgacgacacaaccacctggaactcctgcctgccaccccctgtcaaccagggtcgccactatcagaaagaaatgaacccaccttctccttctaatccccgcctttaggtcctttgccatccattaagacaaatcagatgcaatttggtgctcaggacaagaaaatgctgttggatgtttggtgtaggcatgggaaaaaaaaactatattctgaaacaagactggttagaaggcagcttcccacattttgagggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatcca

SEQ ID NO: 118998 - DNA, 419 bp, Homo sapiens
  Payload ID: 3311
  Gene Symbol: C3orf67
  Gene Name: chromosome 3 open reading frame 67
  ENST ID: ENST00000460459
  CDS Start-End: 1-133
ggactggttaaatatgttgagcccaccaatcgttcctcccagtcaacagccggctgagcagcgtccagattcctgtgaaagtttgagtgttcaagatatttcacacactcctgaccaggctgtaacaagatgattttttagacccacttttcatccaaaacaaggatgatttaatcccagaaagctggagagcttggagacatccaagatgctgacaaatggaccaccgaagaaaaagcacttagcacatgcacatgctcaccaaaatgcaataccatgctatggtcgctcattctgtccacaaagattgcagctttctatgcactctaactgcattctgccacctgcaccctgtggcccacttgaaatgaagtttgactacatgacctgcttctttagccaataaaatgtgagcagaa

SEQ ID NO: 118999 - DNA, 832 bp, Homo sapiens
  Payload ID: 3311
  Gene Symbol: C3orf67
  Gene Name: chromosome 3 open reading frame 67
  ENST ID: ENST00000491845
  CDS Start-End: 520-744
gcttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctgcaaaatgtgatactccagcattcttttcccaagagatatgaagatcttctgacaattcaaatgagattagtgtagactaggacttctcaaaccatttgaagaacgagaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcaggttgctatcaagattttttaattctctgatgtatttttaaaattagccatacctttgggatagtatgagtgtgtggtagcagtttgatgttatgtctgctaaagtaaatttgtcaacagtcatgctga

SEQ ID NO: 119000 - DNA, 949 bp, Homo sapiens
  Payload ID: 3311
  Gene Symbol: C3orf67
  Gene Name: chromosome 3 open reading frame 67
  ENST ID: ENST00000479931
  CDS Start-End: 129-704
aagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtaactcagctccctggaattcataaggtagcacaccatactgctcagatggttttaaacaaccaaaagtattgaaagaatactgatgcctccttttgattttcatctgggattattatttgttaaatcaattcttctagaagtccaggaagcagggctgcatataagatgtcaaagggttcagaagacagcattttatttcaggttttcactggcctccagaattctcttcatcttctaatttaaaaaaccttcatttattaatattggc

SEQ ID NO: 119001 - DNA, 2761 bp, Homo sapiens
  Payload ID: 3311
  Gene Symbol: C3orf67
  Gene Name: chromosome 3 open reading frame 67
  ENST ID: ENST00000468415
  CDS Start-End: 402-992
gcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcagctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgaggtaggagcaagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccacccggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccatca

SEQ ID NO: 119002 - DNA, 424 bp, Homo sapiens
  Payload ID: 3311
  Gene Symbol: C3orf67
  Gene Name: chromosome 3 open reading frame 67
  ENST ID: ENST00000470454
  CDS Start-End: 1-80
gcccaccaatcgttcctcccagtcaacagccggctgagcagcgtccagattcctgtgaaagtttgagtgttcaaggatgatttaatcccagaaagctggagagcttggagacatccaagatgctgacaaatggaccaccgaagaaaaagcacttagcacatgaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaa

SEQ ID NO: 119003 - DNA, 2913 bp, Homo sapiens
  Payload ID: 3311
  Gene Symbol: C3orf67
  Gene Name: chromosome 3 open reading frame 67
  ENST ID: ENST00000484535
  CDS Start-End: 1-561
aataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggatgatttaatcccagaaagctggagagcttggagacatccaagatgctgacaaatggaccaccgaagaaaaagcacttagcacatgcacatgctcaccaaaatgcaataccatgctatggtcgctcattctgtccacaaagattgcagctttctatgcactctaactgcattctgccacctgcaccctgtggcccacttgaaatgaagtttgactacatgacctgcttctttagccaataaaatgtgagcagaagtgatgcacttccaggtgacagatttaagaactggcatactttgccacttgatttttttccactctacatagcaactgtaatgttcaagatgctggcttctccatcagcctgcatcccagaacggggaaaacaaagtggccctgggaaaaagatgaaaacacaacttttctatcaagcccaatagattgaagtcaagagagagcaacgcacgtcttgaaaagaactgagtgggctgggcgcggtggctcacgcttgtaatctcagcactttgggaggccgaggcgggtggatcacctgaggtccggagtttgagaccagcctgaccaacatggtgaaaccccgtctctactgaaaaaatacaaaaattagcttggcatggtggcgtgcgcctgtagtcgcagctactcgggaggctgaggcaggagaatggcgtgaacccaggaggcggagcttccagtgagccgagattgcgccactgcactccagcctgggcaacacagcgaaactccgtctcaaaaaaaaagaaaagaaaagaactgagtgtaactgtgggcacatgaagctgatcagaattaaatagataagaagccaattaagtttttgagagagttgtatagccagagaaatcaggagcctgaactagaaatatttacaactgttcaaaatttaaagctaccctgggccctccccctttccccaggcaggaggcaggctgagaaagctgttctgcccccaaggaggacatattcttcaatgctcactttagatgtgggcaaggaaaggtaaaggaaaatttgcagaagaaagaaccaaatggactgaggagcaacagaatgagaacactgtaggatagcacttcctggccccctatgggaggtggagccaagtcatctcttctaatggtgtgagtggaagtgatgggtccttctcatcttttctgatggtgtgagtggaagtgatgggtcattctcatctgttctgatggtgtgagtggaagggatgggtcgctctcatctcttctgatggcgtgagtggaagggatgggtcgctctcatctcttctgatggcgcgagtggaagtaatgggtcattcttgtctcttctgatggtgtgagtggaagtgatgggtccttctcatctcttctgatggcgtgagtggaagtgatgggtcattcttgtctcttctgatggtgtcagtggaagtattgggttgttctcatctcttctgatggtgtgaagggaagtgatgggtccttctcatctcttctgatggtgtgagtgcaagtgatgggtccttctcatctcttctgatggtgtgagtggaagtaataggtcattctcatctcttctgatggtgtgagtggaagggatgggtcactttcatttattctgatggtgtgagtggaagagatgggtcactttcatctattctgatggtgtgagtggaagggatgggttgctttcctgctgagtgtgtttcttactttccagtgagaggtcctgcagaacactttattccttctggcttaaagactttatcattctgccagactggatccttgagagcctatgataagtagagtgcccctgccagcccatgacagcatgctgtgtggacaagaaacaaactttcattgtattcagcttagatttgagggtcgtatgcttctgcattacctacttatcactgatacaccattggagcaaaaaatcccatctatgaagaaactccaatgatttaccctatatagttctttctctgaatatgtcgtatgccttacctagtgaatcctggggctaaaatggtattgaaatggtcagatccaatcctgagcccctagtcttatgaactaggcctcctctaacaggcagtgctaagcttccatcattcccagacagtggcccaagatgaaagaagacttctctttcccagcttagcttgaatcacaaagcaatccatttgttttggccaaggggatgtgctactcttttaactcagggtcgcaggctttagggtgcacgcgatggaaaagaactcacttgtaactgttgcaccttgagttcttcttgttccaaaaagctccagaaagaagctcagcccc

SEQ ID NO: 119004 - DNA, 461 bp, Homo sapiens
  Payload ID: 3311
  Gene Symbol: C3orf67
  Gene Name: chromosome 3 open reading frame 67
  ENST ID: ENST00000486145
  CDS Start-End: 1-238
cagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaagaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaagc

SEQ ID NO: 119005 - DNA, 2756 bp, Homo sapiens
  Payload ID: 3311
  Gene Symbol: C3orf67
  Gene Name: chromosome 3 open reading frame 67
  ENST ID: ENST00000619205
  CDS Start-End: 1681-2397
gcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcagctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgaggtaggagcaagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccacccggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccatc

SEQ ID NO: 119006 - DNA, 5901 bp, Homo sapiens
  Payload ID: 3312
  Gene Symbol: C3orf70
  Gene Name: chromosome 3 open reading frame 70
  Uniprot ID: A6NLC5
  ENST ID: ENST00000335012
  CDS Start-End: 192-944
gacccggtcgcagcgcccggggcggctcctcctcgagcctgggaccgccgcgctcccgccgccgccgcgtgctggcgtgactcccggcccgtgccgcgccctcccgcgtccgcagccggctcggcttcctgcccacccagacgtcgcttctcccgggctcccggtgtcggctccgcgcggagggagaggaaatgagtgcggcggcctcgccggcgtcggagcggggttggaagagcgagaaactagatgaggctcaggccctggcgcggagttgcgccgcccgcagacccgacttccagccgtgcgacgggctgtctatctgtgccacgcacagccatggcaagtgcttcaagctgcactggtgctgtcacctaggatggtgtcactgcaaatacatgtatcagcctatgacccctgtggaacagcttccaagcactgagattcctgccaggcctcgggaacccacaaacaccattcagatctcagtctcgctcaccgaacactttttgaaatttgcatctgtcttccagcctccccttccccctgactcaccgaggtactgtatgatttcagacctttttattgacaactatcaggttaaatgtattaatgggaagatgtgttatgtgcagaagcagccggcaccacattcccacagaatgagccctgaggaggtctctgcacacgatgccttaatttcaaaagagagcaatacaccaaaaatagatcactgctcttctccctcaagttctgaggactctgggatcaatgcgattggggctcactatgtggaatcgtgtgacgaggacacagaagaaggagcagaactgagttcagaggaagattacagtccagagagcagctgggaaccggatgagtgcacccttctctccccctcgcagtctgacctggaagtgattgaaacgatagaaacgactgtgtgagagtccagacaggaagccacagcctcggacccacgccgagcttttgtacctttgtctggtggatccttttttccaatgctgttgatattttctacccaccccgccccgctccaaccaacaaccgtagcagttcagtggtatgctgattagcttctctccgtcttacaactaagacattctttttattataaacagttttcttttgtatcctgacttactttctatgtagcatctggtgtcatgaattgtgaccccgccttaatttcactgggagatttgaaggcggtgaagtgatggtcgcagagaatcttggatcagattgaggaggtaccgaaagggaaggagccggtgttttctcggtagccagtccttcacagagactcttgccattccctttggcatgttcacaggcactcccgtcctgtcctgcttgtcctacgcaagtagcactccctactgagtgtgcactggtagatgccgtttcttcccttccccttctccccacacctgcactgggtctggatcagagctgcctcggcttacttctgggaggtcactggaggccagctcagcccatggtttgtggccagtgtctgtacaaggctccgtgactggggctgagctaaacattcacatgagaagagatgacctcatctgtctcatgctcaatccagccttagctgagcacctgtcccctgcagggggctgtggggacacagcatgaataagacctgattcccaccatgaaggggcccacagtcctatatatgacacattcaactcatggcacccaaaaagctctgggaacccaggggaaggatgaggtttacttggctggggctagctggggaatgtgtttcagcatttgagctggcttcttggtgggttccccaacatttttctgcttttaattgttcttcaagtctgggaaaaactcttaggaagttatataggtatcacatttaggtggcagccacatctgacatcttaaggaaaaaaaataaattaatagttttagttagcatggaaatgctacagacagaagccctttagggattaggactgaatctaataggtttgattaattctgcttcatttggttgtatgaagcattcgtatggtttaagtgaggaatggattagaattcagtgtgatgcatggatttttatgcagctgcaaaagcagttgaaatagtttgctgctaagtcaggagaaaatatccagtgtaatagccattcactttcccacacagtctgtctgttgtatgtgttctctcccctcacatgcacaaaatagtgactaattctttcttatttagctctcttcagaattctacttctactctccatttataccaggtattcttgtgagtcagttaactgctatttctccaaaccttctatccatgaggcatagtttcaaatcctggaaattttaagtatggcctaatgagaacatcagagttggagacagaacagtacttccatcctaactatccagaagcgcactctcaggccattgtgctctgagattcccttgtgctctggcaccattatggtacatctctacgtcacattaatttttttttttttgagatggagtttccctcttgctgcccaggctggagtgcagcggcgtgatcttggctctctacaacctctgcctcctggggtcaagcgattctcctgcctcagcctcctgagtagctgggactatgggcacgtgccaccacacctggctaattttttgtatttttagtagagacgggctttcaccatgttagccaggatggtctcgatctgaccttgtgatccacccacctcggcctccccaagtgctgggattacaagcatgagccaccacgcccggccggatttgtaagaaaaagttgtgttctcccctgaagcctccatttggcatcattcacaaactactcaaggaagaatttgctttcccagttgtatgtataatttaagtcgtttactagatagaacttttttttaggtttagatggccaagacatctatatggtttagaaggcagagtatacattttcctttgcaaacagtatgagttaaaactttctatgctaaatgagaatgcggcataaagtctccacttactgaaatttaaagattcaacaagacaaaccgagaagggggtcagaggagctctaggaaaggcccaggagagggcagttggaggcaggtgtgagcatgaggagcttccccctgccagggcatggctcaggtggcacagggacatctgatgaaccctgcccgaggttctcggtgcctcccgtgcatgagtggctcactgaaggcaggtgtggaagccaaatgcctgcaagccgtgtgtcaggccacagcagtgcagtcatgcatcacgcactcaggtttgtaacagcaacaccagggccctgtctagattcaccctgtgggtgagcccgttctccagatgggcgtataaaggggctttctcctctacaccgttcctgtcaatgttccgtacaggcccacattcccaccactaagccaatggagtcaaccagatttctaaagccatggatatacgtggtcacggggccacatttctgcagctggctcagtggcaggcttgggccgtctctcagtaccatctaagacttctgtctaggttcctgtttttttagactcctgaactgccattctgattagacacaattttaatggaatttttggatttaataatagttgataatcaccttatgtatttgcacaatctctttataattaaaaactcgctaagcttcacttgctactatctactatatagaattagagacattccattggattctaagcatcagacactcctggatctcaaaatgaccttttctaaataagcacaagatttatttttgtcctagcactgttgataacactctgaaatatgttattgaactggaattgtttctttatgcttgcattccaaaaccaactgaaacagattgtagtttcactttaaattctaggcctgttctatattatgtgaaggaattctctgtaacgctgatactatgttgctaatttgtgtacttacagacactttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaaggtcatacaatacaaaataaaacaaaaacaaaagcaccaagagcagaacaaaacaacgtagttgctttcctgaaatactttttggatttgattctatcttgggagtggtggctttacttttttttttttttttttttttttgagacagagtctcgctccttcacccaggctggagtgcagtggcgcgatctcggctcactgccagctctgcctcccaggttcatgccattctcctgcctcagcctcctgagtagctgggactataggtgcccgccaccatgcctcgctaattttttgtatttttagtagaaacggggtttcaccgtgttagccaggatggtcttgatctcatgacctcgtgatccaccctcctcggcttcccaaagtgctgggattgcaggcgtgaaccaccacgcccggccggctttacttctaatcctccacttcttggtctatttgaaccatcacaagtattttgggaccgataacaaaccccttttatgctaatttaattcttgacttgggtaataggtgcacctggataatttataaagctgtccatagatctaagtttagtggtacagatactactgggcaggagaaaaagcacaagttaaaatatttctacagtcagctcttaatattcccacatcttgtttgcaaaattttatggtcacgttctggcttttttacatgaggaaaacaaagttttaacagttttctcttctgtccccttctccagaggaggtgtgaaccagaactgaggaggccagttatattttaggcttttcagtagtacgattttgtcctctcccactgaggaggagggaagaagggggaagccagtgggagttccacacacgtggtcagtgctgtaagttcccggatatcagtgtctctcacatcaacacagaaatagggcacttctcaacattaattttggaattattcaccatttaaaaattgtcactgctctttttcattactgtagataactgagagttagctgttctaggaaaaggccatgtttcagttagtgctatgacttcttttttcgattaaggttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacagctcaactttccttgatatgtaacactttaggaaaataactgccttgtaaaataaacgtgattttttttttcttttataccagaa

SEQ ID NO: 119007 - DNA, 2577 bp, Homo sapiens
  Payload ID: 3313
  Gene Symbol: C3orf80
  Gene Name: chromosome 3 open reading frame 80
  Uniprot ID: F5H4A9
  ENST ID: ENST00000326474
  CDS Start-End: 1-744
atgtggggacccggggtcactgctgagggcctgtcggtggctccggcgccgccgcctctgctgccgctgctgctactgctggcgctggcgctggtggcgccctcgcggggcggcgggggctgcgctgagctggcgtgcggcgagcgggagcgctgctgcgacgcgaccaacgccacggcggtgcgctgctgcaagctgccgctgcacgccttcctggacaacgtgggctggttcgtccgcaagctctccgggctgctcatcctgctggtgctcttcgccatcggctatttcctgcagcgcatcatctgccccagtccacgcaggtacccgcgcggccaggcgcgcccgggacagcggcccgggcctccggggggcgccggaccgctggggggcgcggggccgcccgacgacgacgacgactcgcccgctctgctgcgcgacgaggcggcagccggctctcaggactcactgctggacagtggcggcggcggccggggccggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaacggccggggtgccgccgccaactgcctcagaccttatctggcaccctggcctaactgcccggcaccccgcgactgggttggggtcactcgtctccctcgcgttctcccgggatcttatgtttctctgcgtttcattccgttcaaagaaacgtggggcacgcgcggcgggtgcggctgcagcaggcgaccctccagcgcaccttcgaaggacgtccctgccctctgccttgcctcgtattgtggttcactagtaagtgcctgcttccctagtcaaagagaacacgtgagccctttggtgcgtcgagagaagggcggtcttctttagggctgaggagaaaggaccgcagttccactcctttccctacctgccgcctggacaggtctcccagggtgggcagagggcgaggagccgttgaggaccagccgcgaccagggactgctgcacgtgggtgtgggagagcgccacttggttatgatgaaatcgctgccatgcggcagaccccccaaaatccctcagtgtcttcctgatctagcaaatagtcacagctggtgtttcacaattaggtggagtgcggggagtgggctaggggggacacctgtgatacaaggttagctgctgtacctactcagggaacagcaaccatgtatatccattcggctggacttttgattgttcaataactgaggaggtatttatatttatttgtcttttattctaatatttttaccatgcattgaacgcaacaggagggtatttcagcaaattcacgacaaggtaatcgtcttatcactttttgtaggccattaatggtcaggaaattgcccatactctgtcattattgtttaataaatcattaaattatttcattaaaaaagaaaaacaggtatggtcaaacgaggaagcatatgtgacataaaaaacatgaaggatatcttattttcactatttgagaagaatatattttatttttagtactgtggcataatatataactttttataataataactgtatgcattatgtagtatagcttttaattgtatcattcatcacagttatatgtaaaaataattgacatgtatatgccataccatgaagcatatgatgttgtgcactttctcctccatttttcatttggaatacattccacaacatgatccaaaacataagaacttacgacttgtaactcgtttaaagccattaattgtgcagtaatgtgctacaggattcaatcagcttctcttaagaaacaagtgtcattgtatcagtttcctgttctgtgacacgccctttaaaagtaaaagataatataacatattttaatacattgtgtgtaatgtacatatgcatattgtctatgtactatatacacattgtttataatattgttattacagtttgtcattcacctgaaaggagaaggaaaagtacgaaaggtttctctgcttgggaaaaggtgaatgttgttatatcaagaacgattacacacatggatctcatacatgtttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaaagaaaaatcatttgaagtgtattaaaaaatagcaaaacattaaaatcttttctctgtgcaaatttt

SEQ ID NO: 119008 - DNA, 706 bp, Homo sapiens
  Payload ID: 3314
  Gene Symbol: C3orf84
  Gene Name: chromosome 3 open reading frame 84
  Uniprot ID: H3BNL1
  ENST ID: ENST00000545770
  CDS Start-End: 88-702
aaattgacctccagagattctctttcctgaagataccctccaaaagacaagaggaaagtttgccttttctgctcccttcttggaaagatgcaaagtgctttagtaggctcctggcacaacaatggcttctatgggcactacagaagccaattcaagagtgaaagtgctagagaataccaccttgcagccaagccccagcctccagcagtgttcctgcagcgatgtcaggagccggcgcagcgacacttcttctccaagcacgacaaccgtacttcctttgacaaaggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctgacaca

SEQ ID NO: 119009 - DNA, 669 bp, Homo sapiens
  Payload ID: 3314
  Gene Symbol: C3orf84
  Gene Name: chromosome 3 open reading frame 84
  ENST ID: ENST00000432035
  CDS Start-End: 52-669
cctccaaaagacaagaggaaagtttgccttttctgctcccttcttggaaagatgcaaagtgctttagtaggctcctggcacaacaatggcttctatgggcactacagaagccaattcaagagtgaaagtgctagagaataccaccttgcagccaagccccagcctccagcagtgttcctgcagcgatgtcaggagccggcgcagcgacacttcttctccaagcacgacaaccgtacttcctttgacaaagagggtccctattgcctgctgcagggaatcggaaggcggaaggacctggagcgcctgtggcagcggcacaccttcctgcgctgggcaccctgtgagatagagttgcgccagcaggggcccctggaatcttcttaccaggctgatttcaggccaggcccaggactcagtggcctcccccagcacctcatccactttgtgcaggtccagccttcccataccaggaccacctaccagcagaacttctgctgcccatcccagggtggccactatggcagctacaaggtagggccccaggcgccggtcactgacgtactgcctgacctcccagggatcccaagacccaagctgctgcagcactaccttcatgctggggtctctgagtgtctaaactggtccagagcattaaacaaggacagctga

SEQ ID NO: 119010 - DNA, 1636 bp, Homo sapiens
  Payload ID: 3315
  Gene Symbol: C4orf17
  Gene Name: chromosome 4 open reading frame 17
  Uniprot ID: Q53FE4
  ENST ID: ENST00000326581
  CDS Start-End: 363-1442
acgttgctaagctatgtaacatatcttaacaaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtggggagttggccagtctaactacttagagaagaacaggataccatttgccaattgcagttacccctccagcactgcagtccaggagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgatatttccatttgtagttaa

SEQ ID NO: 119011 - DNA, 1803 bp, Homo sapiens
  Payload ID: 3315
  Gene Symbol: C4orf17
  Gene Name: chromosome 4 open reading frame 17
  Uniprot ID: Q53FE4
  ENST ID: ENST00000477187
  CDS Start-End: 355-915
aagctatgtaacatatcttaacaaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtggggagttggccagtctaactacttagagaagaacaggataccatttgccaattgcagttacccctccagcactgcagtccaggagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaagccactcttctgtagggctgctgcagtttgctgggggtctgctccagaccctggttgccttgagttttcccatacctagaggtatcatcagtgagagttgcaagacagcaaaggtgtctgcctgctccttcctctgggatctccatcctaggggggtactgagctgttgctggctcgaatgctcctataggagatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgat

SEQ ID NO: 119012 - DNA, 2542 bp, Homo sapiens
  Payload ID: 3315
  Gene Symbol: C4orf17
  Gene Name: chromosome 4 open reading frame 17
  ENST ID: ENST00000514652
  CDS Start-End: 355-1239
aagctatgtaacatatcttaacaaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtggggagttggccagtctaactacttagagaagaacaggataccatttgccaattgcagttacccctccagcactgcagtccaggagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaaatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaaggttaagtacagtttttggtaactattgagttggtataaagaaaccagtaagtactaatgactcagggaacagattttaaggatcagtgcttttaaaaaaacagaaaaatacaatagtaatttccagatcaattcttgagagagcatctgcttactttctcataaagataaatttacctttgttttgaaaggcaaagtgcctgatcatggacagacactctttgagaagcaagacagcaggacaacaggaactataggtttggttatagcaattcagtgaaaagggaaaccctgcattgacctaacaaaaggacaatgatctcagagttttggttcttcacagcttaatggagttaaataatttcactggagacaaagtcaaccagagagaagagtaaaatggcaatcagccacaagcaggtgacctacaagacagctgaaatacaattgaaaagagcagttttgtgttccaccagaagcccagctccagtctgtaggggaaccagggagaatcaagaattgtggaaagtcctaccttggtccaaaatagcccaaagtatccttataggtttggcagtttctagctttaaaacaaggagagcattcatgactacagagcaacaactatgaagtgtatctacaagctttatacaaaaatgtgtcttgtcatttctacaagttccctttataccaggaatgatatataatcaattagagctcactggggtcaccctagactccagcaagttccactgtgattaaccaaacccaaaaaagacactatctcctaacagccaataataagtatagtttaaaaattacaaagtactcccttacttagactccaaggacagcctattgtatctggcctctcctaccaaactcctcatcctgggactataacatcatgacagtgatggtttctattattcaactttatgtcttacctgtaaggctcacacatattttatcatttagatatttggaattttttgtataagaattcccaagtcatgcccctttctctccattgtcgatatttagcatctccttacatccctattcctgcttgggtgcaactatgtaggtcttacgagcacaattaacttgtcttagcctgtttgtctcttctcttgttacatctatcaggaccatagatcttccttctttctctcactgtcactcttacccataaacaattctatgcaatcaaaatcatgtttacttttgagagtgaaggaacatatcctgcatgttacagaacaaataactcattaaagatgagcatgtggtggaaaaaaaaagaaaa

SEQ ID NO: 119013 - DNA, 1949 bp, Homo sapiens
  Payload ID: 3316
  Gene Symbol: C4orf19
  Gene Name: chromosome 4 open reading frame 19
  Uniprot ID: Q8IY42
  ENST ID: ENST00000284437
  CDS Start-End: 179-1123
acacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtggtaacagaaaacaatccagatggggtgcaggtgctgtaaaataatacaaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacg

SEQ ID NO: 119014 - DNA, 1943 bp, Homo sapiens
  Payload ID: 3316
  Gene Symbol: C4orf19
  Gene Name: chromosome 4 open reading frame 19
  Uniprot ID: Q8IY42
  ENST ID: ENST00000381980
  CDS Start-End: 173-1117
cgcggagccgctagcgtctcccggcgcggctgcccgaggccggcgaagccatgggcgccgggaccccgccgccgccgccgccgccgccgtctggccccaggaagagaagttaaacttctagagaaacctaacagacaatatccacaacaggtggtaacagaaaacaatccagatggggtgcaggtgctgtaaaataatacaaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacg

SEQ ID NO: 119015 - DNA, 828 bp, Homo sapiens
  Payload ID: 3316
  Gene Symbol: C4orf19
  Gene Name: chromosome 4 open reading frame 19
  ENST ID: ENST00000508175
  CDS Start-End: 126-242
gccatgggcgccgggaccccgccgccgccgccgccgccgccgtctggccccaggaagagaagttaaacttctagagaaacctaacagacaatatccacaacaggtggtaacagaaaacaatccagatggggtgcaggtgctgtaaaataatacaaagacagagtcttgctgttgtcaccccggctgaagtgcagtggcatgatctcggctcacggcaacctctgcctcccgggttcaactgactctcctgcctcagcctcccgagtagctgggactacaggtgcccgccaccatgcctacctaatttttgtatttttagtagagatggggtttcaccgtgttgtccaggctggtctcgaactcctgacctcatgatctgcccaccttggcctcccaaagtgctgagattacaggtgtgagccaccgcacccggccaagaaatactttttaaagatataattgtacctccattgatctgaactagcaatcacagctgctctggagtctgcaagtctatgaccttcatctacctggaagaaaactgaatggctcacacacctggacctgatccagacagagccttaaaatccatcagctgctcatcagatgatcccatcggatgccaaggaggccatccaaaggctggaatgatcagttctgtgagctattgagctatgtgaagaaacggcggttgatttgctttcttgccaagaaaagcaaagctccctcacactccacggccactgagcatgtaagctcccaagtataaatttcttcccatccaagccctctcactacctagccctgagatatggggaacattaatcc

SEQ ID NO: 119016 - DNA, 895 bp, Homo sapiens
  Payload ID: 3317
  Gene Symbol: C4orf22
  Gene Name: chromosome 4 open reading frame 22
  Uniprot ID: Q6V702
  ENST ID: ENST00000358105
  CDS Start-End: 50-751
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaa

SEQ ID NO: 119017 - DNA, 3349 bp, Homo sapiens
  Payload ID: 3317
  Gene Symbol: C4orf22
  Gene Name: chromosome 4 open reading frame 22
  ENST ID: ENST00000513920
  CDS Start-End: 2-472
aatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtgctggagtgcaatggcaccatctcggctcactgcaacctctgcctcctgggttcaaggaattttcctgcttcagcctcccgagtagctgggattacaggcatgcaccaccacacccggtccgtgatctttattcgtgacagaaattctcatgggcaagagatatcaggatacatcgactatgcccacaggctaaagacggaagattttgaagtctactttactggaaaaaaaagacttcttccaaggcctacagatataagcctgagaaaaaggattcttcagagacaagataagtaaattcccagtgacattcctttttaatgataagtagtgcctaaattttgttaacctcatgaggcttttgcagcacttgggacttggtctgtccagaagcctcaagaactgctcatctaacatgttttcctccacttttctttggtcaccagccaaagtgctggcccctgatcagctcaccctcatttctctcatctctgtcctattctgggacacccattccttaacacccatcattctttttactaccaatgcttgccttttattctagaacccttatctatcacctagcatctaccctacactgccaatctattcacagatgggttcttctactcccttctaaatagcatgcaagctaaaactttttattccctcttacttaactatagaaccccaaaattaagtagcagcattatgctttaactctccactgctgtattcagatcattatttgatgattataacaatacctacctcctctgagatgcctgttatcctctatccacccttactgatattatctgaagacttccttatccatcacctttttttgatttgtttgtttttgagatggagtctcgctctgtcgcccaggctggagtgcaatggtgcaatcttggatcactgctacttccacctcacgggttcaagcaattctcttgtctcagcctcccatgcagctgggactacaggcacataccaccacgtctggatactttttgtatttttagtagagacagggttccaccatattggtcaagctggtctcaaactcctgacctcaggtgatccaccggcctcagcctcccaaagtgctgggattacaggcgtcagccaccgagcctgactcccatctccactgtaatggacttagctctttcctgtcctacctaggataacatttcatttaacttctctcttgcagtaatgcccattgcccatgtctttttgatttttggttgtatctgacctactaacattccaaagtcaatcgatccacacatttttttcactgcacttgtagctaccccactgggtactgctgaaggaaattttaggaaatttcacaaaactgtggattgctgtgctaataacttatggtttccaaactcaattgagtcctttatgattcttaaaacttatgttcaaaattaaattcattttaattcctgaagcctgctattgcttctgtgtcacctgtcttggcaaatggcatcacccttgaaaccaaaggcaaaatccagatgttatcctagacctcttgtttttcatcaccacctttataactaataatttattaaaaacactgaattctattatcttagcagctttgttttgttaaagcaaatttaagatatctcatttcacctgcaaacacttcagcatggatctttatctgataccatttttaaagaaaacatcttggcattatcatacctaacaaaatactttccttaatgtcatctaatacctagttcacatttcattttcacccttaataacatttaattgactgtctaatttattttttatagtttgtttgaccagtcaaaattcaagtgattttgtgttttgtcttactatatcttgacctcttgcatgcttttttttttttttacaacagtccccctcattctttttatcttctacgctattgatttgttggagaaaccaggtcctgataaacattgtcctcaaatgtctcacattctggattttactgatccagtaaaatcgtgctgtttattctactatctatgttcctctattccctataaactgatttgattaaatgcagtataatttttttctaagtaagaaattttaatatgtgatgctctgtactgactatcgccccagttttagatctcctgagctcgatcagtaggttcaagtggtgtcagtctaattacttcattacaagattttccataaaatttcacccaatggtgttagcatctattattgaaagctacctaaatgtttttactaagggttgaataatggtgaatctataattatattatttatcctgaattttttaacttgaattcttctatagagaaaaacttttccttatcacttatttggttaccttgaaataaattcctgcagaaatacaaaataaatatttttttcatttatagaaaatttgaagccagaaacacaaaagagtgtagagattataccaaattatttttcagagtagttgtatcattttgtatccatgagaaatactgcataagtgatctggttatccctcatcctcaccaacacaagatattaacaaactgttctttcccactgtagtgagttataaatgatctctcaatgtggttttcatttttatttacttgattatttattagattgggtatcttttattggctgttcagattttctttctgtgaagtacctattaagatttttccctgttatttcaagtgagctattctttttcttgcaaattataagattcgttttatttatttttggatattgattaatcctttgcctcttatgtgtatttcaaaatatcatctctctgtgtgtagttcttcttcttttttttttttcattgattttgatggtcagaaatcagaagttctgatagtcatcttaatgcattttaaactttacctctgcagtttgtgcttttgtattttgtttaataaaccccatcctttttggaagtcataaatatactgtcttatagg

SEQ ID NO: 119018 - DNA, 753 bp, Homo sapiens
  Payload ID: 3317
  Gene Symbol: C4orf22
  Gene Name: chromosome 4 open reading frame 22
  Uniprot ID: Q6V702
  ENST ID: ENST00000508675
  CDS Start-End: 1-753
atggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtctaaatcaacaggagactgatgctgctcatatcttgaagaagcaactggcatccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaa

SEQ ID NO: 119019 - DNA, 777 bp, Homo sapiens
  Payload ID: 3317
  Gene Symbol: C4orf22
  Gene Name: chromosome 4 open reading frame 22
  ENST ID: ENST00000514249
  CDS Start-End: 28-288
agggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagtgtcagactctcagttaatctttcctagatctggacaaagaaaagcctcaaagaaaacctgtttccatcaatgctgattctctacagatgcaaatctctcccacaaaaggacgctaacaagtgctggtaaagacctacaagataattttctgacggccctggcaatgagagaagaagacaatcgcagtggaaaactgagtggtatacaaaaatggttaaaactctgtccaagctttcaagaaacaacagtggacaacatcaaattgacaccaaggagatagatggatggtgagtttacttctcactaagaagataagggagacttcacctagaaagtgcggtttaaactgcaacttaaaataagcagttttctggtatacagctagagggaaaggtcatttcagagggaggaaactggactaacaaagggcgataggaggagagcagaaagtattacagagggaagaaactatgggtcaggaggagaagggagctacctgaagtcca

SEQ ID NO: 119020 - DNA, 228 bp, Homo sapiens
  Payload ID: 3317
  Gene Symbol: C4orf22
  Gene Name: chromosome 4 open reading frame 22
  ENST ID: ENST00000621014
  CDS Start-End: 1-228
agcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacgtacaagctgtcatttttgaccacatttccagaaggaagacttaa

SEQ ID NO: 119021 - DNA, 1874 bp, Homo sapiens
  Payload ID: 3318
  Gene Symbol: C4orf26
  Gene Name: chromosome 4 open reading frame 26
  Uniprot ID: Q17RF5
  ENST ID: ENST00000311623
  CDS Start-End: 36-428
atcaggttcaacgcagtgactgctcagtagaagccatggctcgcagacactgcttctcctactggttactggtatgctggttggtggtaactgtggcagaaggacaagaagaggtatttacgcctcctggagattcacaaaataatgcggacgctaccgactgccagatctttacactcacccctccacctgccccgaggagtccggtcacaagggcccagcccatcacaaagacacccaggtgtcccttccatttttttccacgaaggcccagaatccattttaggtttccaaacagacctttcgtcccttcaaggtgtaaccaccgttttccattccagccattttattggccacaccgttaccttacttataggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggacaataaccacgttatttttatcctcaacctcttatggtcacaggatatttatgcaaataaaatctttaaatgggtggctctagtaattcctatccatactaagatgctgagagaatccatctcctcctctaaattaaacaggatttaaataaattgagatcattataaaccacacgaagaaactgatgacaccgtttttatactcattggaaaacatacagagcaaggtgcattgacaaagtaaactttaaaagaaattataaagcttaaagcaattaaaaagttatgaggagtctgactgtagctaatactttaaagatataaactgacttgtctaacccaaataataataattattattattttcttggagacagaatttcactcttgttacccaggctggagtttagtggtgctgtctcggctcactgcaacctctgcctcccgggttcaagcaattctcttgcctcagcctcccaagtagctgggattataggtgctcgctaccaagcctggccaattttttgtatttttagtagagatggggtttcaccatgttggccaggctggtctcgaactcctgacctcaggtgatccacccacctcggcctcccagagtgctgggattacaggcatgagtcactgcgcccagccccaaataattacttttaaactatagtatctaaatttactttaatgttgacttcaactgatgcaaattaatttgataattttctcactgtttcccgttatcattacatagatgctggctaaaataatatacttcctctcaaacttttaacgtaattccaggttcaaaatgcctgattaaactgctacaagaatattctggtacctctagaactccacagagataagttcactcaactcttggaaccttgtattctcagggtgcaatatgagaaacaaatcccacagattgcattgattggttatttgttttggccactctgtaaaacacatcttcctgtttatgccacttatcttgcctgtaacataagaactttagttctgcatatgtggtcagtggtttgcactttttcctcccaagatctacatgcaaaagttgctgttgctgctgctgctacaaaaacagaaaaaaaaaaatcaggatgaagacatgaaaggactttgggaatggttgccctaaaaaaggaaagagagataaaatcatcatgctatgtttctttgctttattaaaatgatcaaaaaagaaaaaaa

SEQ ID NO: 119022 - DNA, 560 bp, Homo sapiens
  Payload ID: 3318
  Gene Symbol: C4orf26
  Gene Name: chromosome 4 open reading frame 26
  Uniprot ID: Q17RF5
  ENST ID: ENST00000435974
  CDS Start-End: 19-549
gactgctcagtagaagccatggctcgcagacactgcttctcctactggttactggtatgctggttggtggtaactgtggcagaagcactgtccactttctatctccagcagcatattaatttgcacatggacaagaagaggtatttacgcctcctggagattcacaaaataatgcggacgctaccgactgccagatctttacactcacccctccacctgccccgaggagtccggtcacaagggcccagcccatcacaaagacacccaggtgtcccttccatttttttccacgaaggcccagaatccattttaggtttccaaacagacctttcgtcccttcaaggtgtaaccaccgttttccattccagccattttattggccacaccgttaccttacttataggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggat

SEQ ID NO: 119023 - DNA, 635 bp, Homo sapiens
  Payload ID: 3318
  Gene Symbol: C4orf26
  Gene Name: chromosome 4 open reading frame 26
  ENST ID: ENST00000511093
  CDS Start-End: 36-158
atcaggttcaacgcagtgactgctcagtagaagccatggctcgcagacactgcttctcctactggttactggtatgctggttggtggtaactgtggcagaagtagagacggggtttcaccatgttagccaggatggtctcgatctcctgacctcgtgatctgccagcctcggcctcccaaagttctgggattacaggcatgagccacagcgcccggccaaaatccgcacatcttaaaggacaagaagaggtatttacgcctcctggagattcacaaaataatgcggacgctaccgactgccagatctttacactcacccctccacctgccccgaggagtccggtcacaagggcccagcccatcacaaagacacccaggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggaca

SEQ ID NO: 119024 - DNA, 1725 bp, Homo sapiens
  Payload ID: 3318
  Gene Symbol: C4orf26
  Gene Name: chromosome 4 open reading frame 26
  ENST ID: ENST00000616557
  CDS Start-End: 36-293
atcaggttcaacgcagtgactgctcagtagaagccatggctcgcagacactgcttctcctactggttactggtatgctggttggtggtaactgtggcagaaggacaagaagaggtatttacgcctcctggagattcacaaaataatgcggacgctaccgactgccagatctttacactcacccctccacctgccccgaggagtccggtcacaagggcccagcccatcacaaagacacccaggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggacaataaccacgttatttttatcctcaacctcttatggtcacaggatatttatgcaaataaaatctttaaatgggtggctctagtaattcctatccatactaagatgctgagagaatccatctcctcctctaaattaaacaggatttaaataaattgagatcattataaaccacacgaagaaactgatgacaccgtttttatactcattggaaaacatacagagcaaggtgcattgacaaagtaaactttaaaagaaattataaagcttaaagcaattaaaaagttatgaggagtctgactgtagctaatactttaaagatataaactgacttgtctaacccaaataataataattattattattttcttggagacagaatttcactcttgttacccaggctggagtttagtggtgctgtctcggctcactgcaacctctgcctcccgggttcaagcaattctcttgcctcagcctcccaagtagctgggattataggtgctcgctaccaagcctggccaattttttgtatttttagtagagatggggtttcaccatgttggccaggctggtctcgaactcctgacctcaggtgatccacccacctcggcctcccagagtgctgggattacaggcatgagtcactgcgcccagccccaaataattacttttaaactatagtatctaaatttactttaatgttgacttcaactgatgcaaattaatttgataattttctcactgtttcccgttatcattacatagatgctggctaaaataatatacttcctctcaaacttttaacgtaattccaggttcaaaatgcctgattaaactgctacaagaatattctggtacctctagaactccacagagataagttcactcaactcttggaaccttgtattctcagggtgcaatatgagaaacaaatcccacagattgcattgattggttatttgttttggccactctgtaaaacacatcttcctgtttatgccacttatcttgcctgtaacataagaactttagttctgcatatgtggtcagtggtttgcactttttcctcccaagatctacatgcaaaagttgctgttgctgctgctgctacaaaaacagaaaaaaaaaaatcaggatgaagacatgaaaggactttgggaatggttgccctaaaaaaggaaagagagataaaatcatcatgctatgtttctttgctttattaaaatgatc

SEQ ID NO: 119025 - DNA, 1230 bp, Homo sapiens
  Payload ID: 3319
  Gene Symbol: C4orf27
  Gene Name: chromosome 4 open reading frame 27
  Uniprot ID: Q9NWY4
  ENST ID: ENST00000393381
  CDS Start-End: 77-1117
tttgaacccggaagcggttggcggcgctcggaagcggccgcggatcggggaattctgctggcgctgcagctgcagaatggtcggcggtggcgggaagcgcaggcccggcggagaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttagagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtttataa

SEQ ID NO: 119026 - DNA, 2960 bp, Homo sapiens
  Payload ID: 3320
  Gene Symbol: C4orf3
  Gene Name: chromosome 4 open reading frame 3
  Uniprot ID: Q8WVX3
  ENST ID: ENST00000399075
  CDS Start-End: 1-600
atgaccagtctaataaatagccccattaataggagaccattacagaatgtagagggaaataataggtgccaaaggaaggcaaaaaactatggaaacaaatacttcattcactgccttgatcttgagaaaataaccctctccccaagaagaaaacatgacatagaaggtggagacaagttaaatgtgaagttttcacaattgcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttatatagctgagtttggttttattctaacaaattacctggtggtgtgattgtgaggtgattaacagttctcacatagtttactgttaggtcacacacagacttccgatcataatccatactgcctttttgagcctaaaatcagcctactaccacaattaccaaatattctgaaaatttctagtatggtgaagatggagagatcttggtgtgaaggttaattttatatgtcatcttgattatgctaggagatgcccagatttctgggtttgtccatgagggtgtttccagaagagattagcatttgaatcagtagactgaataaaaaagagccacccactccactgcgggtgggccaaccccttgagggcctagctggaataaaaaggcagaggaagggcaaattctgtcttctctctgcttgaacagggacatccatgttctatccttggacattggttctcctgattctctggctttcagacatggaccagggcccctggttctcagacctttgggtttggactggaactacaccattggctttcctgggcttactgtctgcggaaagcagattgtgggacttctcagcctccataatcacaagagccaatccctcataataaatttatttctatata

SEQ ID NO: 119027 - DNA, 667 bp, Homo sapiens
  Payload ID: 3320
  Gene Symbol: C4orf3
  Gene Name: chromosome 4 open reading frame 3
  Uniprot ID: Q8WVX3
  ENST ID: ENST00000504110
  CDS Start-End: 387-587
aggagaggtgacctcgtgcagtttcagggaggagtccatcacctgactggactgggcctttcagggggacgagaacgtatttcttccaacgaaacctgaataaccagctatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaag

SEQ ID NO: 119028 - DNA, 8901 bp, Homo sapiens
  Payload ID: 3321
  Gene Symbol: C4orf32
  Gene Name: chromosome 4 open reading frame 32
  Uniprot ID: Q8N8J7
  ENST ID: ENST00000309733
  CDS Start-End: 185-583
gagccagtgacaggaggggccgggctggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgggtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttgtaagtaaatttatacatggatgtcacttaaaactaaactcttgatcataacagggttgaatatatattttgaatatacattagcttattcaaaactcttgtttcactactgtgatctctgtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaagaaataagatattttgctgttattctttctacatatattattggtcagtacatcaaataatatttggctttgatatgggaaaaaacaaactttgcctatgtaatggaaataaaatattttcttttatgaaatatattagaatgcagattatactaatatcctgaaataaaactggtaatttatttggttcatggtataaagaattagattgggccgggcgcggtggctcacgcctgtaatcctagcactttgggaggctgaggcgggtggatcacaaggtcaggagatcgagaccttcctggctaacatggtgaaaccccatccctactaaaggtacaaaaaattagccgggcctggtggcaggtgcctgtcgtcccagctactcaggaggctgaggcaggagaatggcgtgaacccgggaggcagagcttgcagtgagcactccagcactctgggtaacagagtgagaccccatctcaaaaaaaaaaaaaaaaaaaaaaaaattggattgaaaatgattctcatcatttcaatctcaaatacaagccagttttagaaactgttattgcttatgaataaagaaatagaagttacaatgctaaggttattacataatgcatactcatatggccagtaattcaaaagaaaaaggtcgaagtctacaaataaacagactgtagatgagtaaatccatttttcttaaagtaaaaactctgtattttgtagaattctgtcctctcataccttaagctgtcatgggcaaggtattttcccattcctggctacaggcagatcattcctagtccagtagtgtgctggagcaagcttgcactggcttacaagagccaactgtgaacattttttctgccttcagtgctgtcaagttggtagtttgaaattggccatggtgagagtatttacaccaaaaaaattagtaaacactgcaaatcagatcttttttttttttttttccttgaaagccagctgttaaacatacatcagcacaccctagaggccacattcccatttctattcctacagatacgaaagtaaagaacagaacacattttgtgaaataaaagaaagcatatgaggtaaatccccatcgacccacccaaaactgaatctggctctttcccttgtgggtattatggttcatggttatcttctgaccaacaaatctctatttaatcatgttttgaccacagaaaatctctctaggctgtcaccaagctgtaaatccactaaagactatccaggcaatcaggaaaggcaaaacttacagaatgatagaggaaaaattacagtataagtaaaggtctgttgtaatatagaaagctcaaaatagtcaaagccaggtttggagcaatcaaaggctattcgtgtggttcatagattgttttaatagttattttacaaatgtttattaatttcaggtgtttaaaatgctttcattaccaatttatggctttacaattgaagggagaaaaaaaaatgtaagacggccaggcgcggtggctcatccctataaaagtgctgggacagcactttgggaggccgaagcgggcggatcacctgaggtcgggagttcgagactagcctgaccaacatggagaaaccccgtctctactaaaaaaaaaaaaaaaaaaatacaaaattagctaggcgtggtggtgcatgcctgtaatctcagctactcaggaggctgaggcaggagagtcgcttgaacccggaagccaaagtttgcagtgagccaagattatgcccttgcactcaatctgggcaacaagagcgaaactccatctcaaaaaaaaaaaaaaaagactttcatgcctggtaatagagttggccgagaagaatataaacttatttacaaactatgacttcaggagtattggtggattagaggtcatttgcaactcttgtctctctgcccaacatttaatttttggtatgcgttggagttcagtccaacagcctgctctcacatcactccacacagcagctcggcaatgtcaccactcccgtggctgcagagttaccatttgcatcctaacagctccccaatttgcatctctagatcagagcactgtacagaatttaagactcctacattcaattgcttgcccaatatttatttgcatttggttatcccatagtacccaagactcagcgtgtccaaacgagcgcagcatccttctcccaaatctttaattcctgtttcccatctcagcaaatgacacaatcctttccctaactgctcaagcaggagttgtagatgacatccttgactctgtgtttcctacactacctacatgtaaccaagtaccaaatctattttacttctaaaaatataatctttctacttctattcattcctagcatcactgagtccattctgccatcatctcacctggcatgctgagaatcctgattagcctccctaccttcattttccactttgtagttacagatctttctaaagaattattctaacatgattctgatatccttgacctaaatcttttcaatggctttctgttttcgttatgataaagtccttatgccttaatatgttttacaaggctcttcatgtactggttcttgcgtacctcatctctctatactgccactctccatttccaggattcaactatactgaacttttccccagttcctttaaagagacatgctttcttacttccagaactttgtacatgctttacttctttaactgctccctaccagactgaccaatatctacacagccttaagacctcaagtgagacatcatgtcctccagggaaacttctctgactcctttaaatccagttttggttcttcattatggcttggtttctcaagtgcaaccctgtgctttccaggtcagcacttctcatgctatattgcaatagcttatttgtcagctgctgctttaataattgattaattattaaattaatcaataggcttcacaagggaagagaacatgtctgtcattctataattgcattgctagtgcctaacacaatgcctgggacataataggccatcaaaatatttatcaagtaaacccacttcatctactcatggtcttcatatagaccactaacaaaaaagatctagagctggttgtactttgaagttctttgactccaaaagtatacttactgtgcacaaagagcatgggttgatgtatacattataatttataaagctattcacttctgataaaagaatactgctgttatttggatacatacacagtatttccactatacacttgtgtattttaggagaaaatgtattttcaatgtttggttgattcactatttttccaaaaaggatattttacaatacctacggtcactgatactaccagaacttcacttttgttcagtattttttaatagacctttatttactacattttaattttttaatttttttcttttattttattgttattatactttaagttttagggtacatgtgtacaatgtgcaggttagttacatatgtatacatgtgccatgctagtgtgctgcacccattaactcgtcatttagcattaggtatatctcctaatgctatccctctcccctccccccaccccacaacagtccccagagtgtgatgttccccttcctgtgtccatgtgttctcattgttcaattcccatctatgagtgagaacatgtggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgagtatatacccagtaatgggatggctgggtcaaatggtatttctagttctagattcctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggtcagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctgccattttgtaagttgcctgttcactctgatggtagtttcttttgctgtgcagaagctcttgagttgaattagatcccatttgtcaattttgtcttttgttgccattgcttttggtgttttagacatgaagtccttgcccatgcctatgtcctgaatggtaatgcctaggttttcttctagggtttttatggttttaggtctgacatgtaagtctttaatccatcttgaaataatttttgtataaggtgtaaggaagggatccagtttcagctttctacatatggctagccagttttcccagcaccatttattcaatagggaatcctttccccattgcttgtttttctcaggtttgtcaaagatcagatagctgtagacatgcggcgttatttctgagggctcttttgtgttccattgatctatatctctgttttggtaccagtaccatgctgttttggttattgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttctccttgaagaggtccttcacgtcccttgtaagttggattcctaggtattttgttctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatactttttacttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctgatttattgagagtttttagcatgaagcgttgttgaattttgtcaaaggccttttctgcatctattgagataatcatgtggtttttgtctttggttctgtttatatgctggattacattgattgatttgcgtatattgaaccagccttgcatcccagggatgaagcccacttgaacatggtggataagctttttgatgtgctgctggatttggttcgccagtattttattgaggatttttatttttaattttttgttttgttttttgaggcgaagtctcgctccgttgccaggctggagggcagtggcacgatctcgactcactgcaacctccgcctcccaggtttaagcaattctcctgtctcagcaggagtggttgggattacaggcacatgctggcatgcctgtatttttgtatttttagtagagacggggtttcaccatgttggccaggatggtctcaatcgcttgacctcatgatccgcccgcctcggcctcccaaagtgctgggattacaggcgtgagccactgcacccggcctacattttaatttttacaaaaaactcttaaacttttttgtgagcagaaattctcaagtatcgaagcgtggtgttttaggctccagaagaaatccactattacagtgtcctagtagcccagacatatgtgttaaatgacatgtatatactttgttattctttctaataaataatactcttttacaa

SEQ ID NO: 119029 - DNA, 6170 bp, Homo sapiens
  Payload ID: 3322
  Gene Symbol: C4orf33
  Gene Name: chromosome 4 open reading frame 33
  Uniprot ID: Q8N1A6
  ENST ID: ENST00000281146
  CDS Start-End: 722-1321
gaagattgctggggactccacgttcaaccgaatcccacgctggtgggaagaggacgcggtcgatacaggcgtcccgcgggtcactctgggtctcgtcgggccacctaggagagtgccgcgggagcttgacggcagcctgagagcggcgttctacgcggagcggcgggggttggagaggacaacgccaagacggctgggaagccccaggccagcagcggaagtccactcggcccgccctgcgactttgaaaccggtgccccggaccactccttggagacggtggcgcctcttgcgtcatcacgcgggcgttggagcttacgccatcgcgcgtcctagagtcctagcacgctattggctggctgtcaagcaatgggaggagtcgtgagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagtttacattgagtttatatgtttccattgaacaatcactagtgatggttaaatgtggcttatcgacttactcatttcttatatatgttctctatctaaaaagagagctggtgtaagataaatgctaacttttacaaaaggtattattaagtatcctgactacacatcatggtggcagtgttaggcatcttagataaattgagaaattattcttaaaactgacaatagcaactaattaatttgatatagaaacgatctgcctgttttagatacgaatggcatattttaaataacctaggacgatttatttataaattacctgaataattttataaatgcatataaaactatcaaaataaaaacaagatatattttagagcatcttgattttagaagcgaatcgaacactgtgaatcacagtttcagatataaatcataactatttataatatggataaaaatgaagcacaaatatgatagatacaatcacaacaatataaaatactgaatttgaatgttgtagcttgtgagctttctcaaatctaatgtgtatctttttaaaatttgtttagatgttttttaaacatctcttaactttctttcatctagataaggcatttccttttcttccaataccaagcaagcaaaaatacattatataaacattttcttttgaaaggaacatgcatatcaactacagaatttcggaaagcttgtccattagtcaggtacaaatgatatattctagaaacttgtatccaagaaacttttatttgagagtgggtgtttgtaatagccatttcaaatttgtttttcaacttcaggaccatgaaagaataatcatccttttgtttaaaatatgcataaatgcatttctttgctgtgatttgaattgttcactgcagtgtcaagcagattctctcttctcaccacctaaatagattacacaatgtgcatatttattcaggtgcattctcatgctttttcccagctccaggaaagtgtaagtcacagtctgaagggaaatgtgctttttatttttggctccaaactactttttttaaacgttaaaaaggttttttgccacaggaaaaaaaacatttaatttcccctccttctcctccttttgctccttttttaaatgttaggcttttggaggacagaagataatgagcataattaatctgatattgaaaaagaaagggtagcaagtggataaagcaattacagtaagccctcagcccttttctcatgcctcaaagcttaaggattgtctcttcttttccatgtaaatttccataatattttacacattgctttattacagcatttatttcactggtcctagatagctcttctgacccacctcctatcctctcagcctaactttttactccagccatcagttgcatacagtgaactgactggccagttgcctcagctgtactgtgtatgtcttacttcctgcccctagggcttctctgcttcctctgctgtgtggaacacttgcaggaacccatttagccattctctcacatgaactacccgggatgtgtgaagggactaaaacaccccatggggcacctcttgaccaaagagggtgggagttgatggataactacttctctgttacatccctcagtttaacaatttatggtcccttccacacagctcctcagaagttctcttaaaaggattccaccctgattacccacagcagtggccaactagtaacacatttttgcattatctttccttcatttccatcattttctgttttgctcttcctggtacctctctcctctctggaattgcttaactacagtcaacctctttggaagttattgtcctatgtttgcttcatggggaacccaggctaagtcagtgattacctaaagcagccctagaaagccgttcgtcaggatgagaatctagaattgtatcacagggcatttggtgacaaggaccccattgttggtggtaatggctctgctataagtaacttcacagttattaaaacagtggtagactggcttgaggtgcagctgaggcacctgaagctatgaaagccatctagtcataatgactcttcgtgtcaactgttcagcaggcaaatagaagcgggctaccatgcagagctagagttataactattaatggaagcagtatagagtatgtccttcctaggggattcattgagtcatcctttggtgtttcaatgtcaagtggtaatcttaaatgggcaactgtagcaaccacagcctgacaaggtaaagcaactaaggactctgaccctttgaggataaaggtctaggtcacctcaccattcaaaccacttgaaactactgaagagtttggccaaatgtgagagaaatacagaatttgtgatggaagagagagatgataactatcaattatagacttgaaatcagttacaggagccacataacttgttccactaaatcttttgcatttagtatttgtataatggctgcccacttccttgaagactctgtgacagattggactcaatgtggaatgtgtgtggctctgagtgctgcaaggagtggactgtatttaatatctcttgtgtcctacctcacatcctcttaggccatttttcaattcacccattttactctttgatagcactttacctcttttgtcccatgtatctctagatttctgtattagtgcttttctgacacctcagttatgtggaacacctgtgggaatctgctaatctactctgacgtatatgcaaacctggaagtttgagggaattgacaatagggacaggattcagtggataaatactccccttttccgtcccttgggcagacaattctgaagtgcattctgtatagttccttagtggtctccagtaggactccactagggtcttcagttacctacagtactgatcagcttaaaaatgcaatcttagattggcttgctttatttaatttttccaaagttcccaatcccattccttagaatcacattccaaaattaatgcactgcacacaaccctctgcttttgtcaggggtagaaggggtatccagcctaaggcacctaagtccaagaggaatatgtgcctaacaaatcttctaactaaatatatatatatatatatatatatatataaaatatatatgtttatatataacatatatatatagagagagagcataaaatgtgctgtgtatgtgtgtagcatattttttgttaaatcaccattcctgggccctactcattttctgataatttcttatcttaatttgctctgaaagagcaaaacttataaaattgactattgtaactctattttttaccaactatcatttttcatggaaggaatagtaaaaagagttacctctgaagctaagatgacacatgtatgaggaatataggaagccagaaatcatgaatctatgaaaagtgaggggtgtctgtgcatattttattttatttcataataaataaccagtaattaaaatattcttttccatgtaatgggatctacgagtaaatttttgtctgatatttataaatctaatatgtaatataaaggagaaataggaaatgctgtcaaatgacatttcactttactacttatttgaattacaatgaaataatatatagctacatcactggctcctgagagagctttgggtgttctgtaaattttttactttgcactcttgaaaaattcgcagagaatgcaaggtttagtaaaaatttattttcttttggcagcctatcacctgtaatttccgttaaacagcatttctgactcaatagtacactgaaagcccatgtttgtaataatgccctaaagcactgcagtacctagagtatatattttgaagagatagctttgctgaaatagaaaaccaaactgtaaattgaagtctgagcattcagagaaataaaaattatgctaaaaacaaacgt

SEQ ID NO: 119030 - DNA, 1588 bp, Homo sapiens
  Payload ID: 3322
  Gene Symbol: C4orf33
  Gene Name: chromosome 4 open reading frame 33
  Uniprot ID: Q8N1A6
  ENST ID: ENST00000425929
  CDS Start-End: 93-692
gcagctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgattctttgtagatgatttcatctgtaaagtcacaatgtttctcagagtcacttagtccaggatgttgcattcccagcacacagtacagttattcttgaaaactacaagtgaaaaagggggaacaattgaggttgtccaaggccacctagaggactgtcttgcactaccttgtgattcaaccatttcattcctagatatataccccagaaaaatgactgctcatagcagctttattcataatagcacaaaattgtaaacagtgaaatttccatccataggaaaatggatagacaaactacaatatagtcagtggaatactgttcatttaaaaaaggactgctgatacatgcaacaacctgtatgaatctcaaaaacattaagttgagcaaaacaaaccaaacataacatactatctaattacttttatattaaagccacttccaggcaaaactaatatttgatgatagataccagaacagtggctgcttagagtgagggcagggaattcaaattgaatggaaaaggggcctgaggaaattttccggggtgattgaaatgttttgtattttgatctggatgatggttatgtagctgcatatatttgtcaacattcctcatgctgtatgtttagatttgtgattttactatatgtaaattaattccttaataaaatactattataaaataagctgtaaattaaatggaattaacttcaagttt

SEQ ID NO: 119031 - DNA, 396 bp, Homo sapiens
  Payload ID: 3322
  Gene Symbol: C4orf33
  Gene Name: chromosome 4 open reading frame 33
  ENST ID: ENST00000508673
  CDS Start-End: 91-396
agctgggtggagcctaaagccgagccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtcccaagaacttcctttatcgttcagaatgtccagaggagagacaaaatgggaaggcaaagcttatc

SEQ ID NO: 119032 - DNA, 1126 bp, Homo sapiens
  Payload ID: 3322
  Gene Symbol: C4orf33
  Gene Name: chromosome 4 open reading frame 33
  ENST ID: ENST00000502887
  CDS Start-End: 339-836
gagaacctggatgacagcgggctgagccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggtcatctcaagaagagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagcaatatttagaagttgaactttgtccccacggacagcatttagtgcttttactttctggaagaagaaatgtgtggaaacaagaacttcctttatcgttcagaatgtccagaggagagacaaaatgggaaggcaaagcttatctcccttggagttattttccaccaaatgtgacaaaattcaattcatttgcaattcatggatcaaaagataaacgaagttatgaagctctttaccctgtacctcagcatgaactgcagcaaggacaaaaacctgatttgtaagtagaaaataaatgaagatatgttccaaatacacgagttttttcgaaattaattcttagtggagcagaagtaacacttttgatcaaagaagacgacatatgtgcacaagtatctagtagagtccaatgttcactgatggtcctcagaaaatacttggaaaactttggactgtcataatctctctcactactgtcagtagagcacttatttttccatagtggtatgagaaaagtgttgtttgcatgtgagaaaagtaaatgttgtaatagctgatatagaagtatggtcac

SEQ ID NO: 119033 - DNA, 465 bp, Homo sapiens
  Payload ID: 3322
  Gene Symbol: C4orf33
  Gene Name: chromosome 4 open reading frame 33
  ENST ID: ENST00000508622
  CDS Start-End: 272-465
ggctgaaaagaagaagccagtgtttgagaaaagcttcgtggtctgtgttctctagttgttccctcttctctctgacattcctttcgtcgtcgccagaatttttgtggatttggtggttgtatgaagaataagtgaatctaccagaacttcctagtagctaagatcttgattcccagaggatccagtaactgagacacctgcacactttacaataaataaaagacaaaggatgacataagaacccatggtgcttatagttacaagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatt

SEQ ID NO: 119034 - DNA, 881 bp, Homo sapiens
  Payload ID: 3323
  Gene Symbol: C4orf36
  Gene Name: chromosome 4 open reading frame 36
  Uniprot ID: Q96KX1
  ENST ID: ENST00000295898
  CDS Start-End: 287-640
ggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttatttta

SEQ ID NO: 119035 - DNA, 2306 bp, Homo sapiens
  Payload ID: 3323
  Gene Symbol: C4orf36
  Gene Name: chromosome 4 open reading frame 36
  Uniprot ID: Q96KX1
  ENST ID: ENST00000473559
  CDS Start-End: 665-1018
actttacggcgagattaagctcagggtcaagttctgagcaaaaagtgtcaaggagcctttttgcaacctcctataatattgaaacagattctgtgccctttaaaggagataataactaacatctggggagcgctttacaatttagaaaaggcctttcacacacaggcctgtttcatcttcacaacaatcttataaaacagatatattgttcccatttcccaaataatgaaacggaagcgccgaaaatatctcctatagggctcttcaaactgtggtcaacttagtaaatgatgttgacagtggaagtgtgatcattttattttcctgcctttggaattgaagattgtaattttgcaaaaattttgttgaagatgatgtagctttggttcagagagctggagtacaatggcaccatctcagctcgccgcaacctccacctcctgggttcaagcgattctcctgcctcagcctcccgagtagctgggattacaggttccaagtctcttcttcggcctctcaaacatggtaccatccctaatgaagtcaacgggtccagcatgacaggatggaagtacaagtgtcagcacctatgtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacagtcagttcatgattgaatctgtactctgtgtcttgcatccaaagggcatgaaggtctctggacctttcactatgtatagttcagggcagatatttgaatgcccactggtggatgggccactgcccacagctgtgggttagtacccagttctgacagatcttctgagtccctgacatactcttgttccttgtgtcacaaacgacagcactgtaagtagatgaaaatgcatttggagttgagtcgtttgtgctattcattttaatttttgtaaaattgcactaaaagaagaggaaatttcttcagctgcattgttttcaaaagacatcttaaatatgcatctttgagatcccaaggagggaccaaaagaaggcaagagagaaattctcttaaaaatgataaactgaaacatttcatttggttaagaaaaataatagacttcatttttagtacctccctagtttccaattttcttttttttaaatatatatattttttattgtactttaagttctagggtacatgtgcacaacgtgcaggtttgttacatatgtatacatgggccatgttggtgtgctgcatccagtaactcatcatttacattaggtatatctcctaatgctatccctcccccatacccccaccccacaacaggcccccgtgtgtgatgttccccttcctgtgtccaagtgttctcatttttcaattctcacctatgagtgagaacatgcggtgtttggttttttgtccttgtgatagtttgctgagaatgatggtttccagcttcacccatgtccctacaaaggacatgaactcattattttttatggctgcatagtattccatggtgcatttgtgccacattttcttaatccagtctatcattgttggacatttgggttggttccaagtctttgctattgtgagtagtgccacaataaacatacgtgtgcatgtgtctttatagcagcatgatttatattcctttgggtatatacctagtaatgggatggctgggtcaaatggtatttctagttctagatccctgaggaattgccacactgtcttccacaatggttgaactagtttacagtcccaccaacagtgtaaaagtgttcctatttctccacatcctccccagcacctgttgtttcctgactttttaatgatcctcattctaactggtgtgagatgatatctcattgtggttttgatttgcatttctctgatggccagtgatgatgcacattttttcatgtgcctgttggctgcataaatgtcttcttttg

SEQ ID NO: 119036 - DNA, 766 bp, Homo sapiens
  Payload ID: 3323
  Gene Symbol: C4orf36
  Gene Name: chromosome 4 open reading frame 36
  ENST ID: ENST00000506308
  CDS Start-End: 428-766
ggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtgtgggaaggagccgaggctgaggccgttcccttctccgcgggctctgtgggcggccgaggcccccacccgtcccgggaaccagttcctcccgggccctgcgcgtccgtccggggaagggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacct

SEQ ID NO: 119037 - DNA, 1610 bp, Homo sapiens
  Payload ID: 3323
  Gene Symbol: C4orf36
  Gene Name: chromosome 4 open reading frame 36
  ENST ID: ENST00000462714
  CDS Start-End: 203-301
cgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaagtgaacagagttatctgtgacattccatcaggcacctatgtaacgaaatcataccgtaataactcaccatggcgtatggagtgccaagaaagaacacagtgaaaaccattttgcggggcagttgttataatgtgctggaatgttgtgcacctcctgggcttgagtgatcctcccatctcagcctcctgagtagctgggaccacaggcacacaccactgtgcccgacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacagtcagttcatgattgaatctgtactctgtgtcttgcatccaaagggcatgaaggtctctggacctttcactatgtatagttcagggcagatatttgaatgcccactggtggatgggccactgcccacagctgtgggttagtacccagttctgacagatcttctgagtccctgacatactcttgttccttgtgtcacaaacgacagcactgtaagtagatgaaaatgcatttggagttgagtcgtttgtgctattcattttaatttttgtaaaattgcactaaaagaagaggaaatttcttcagctgcattgttttcaaaagacatcttaaatatgcatctttgagatcccaaggagggaccaaaagaaggcaagagagaaattctcttaaaaatgataaactgaaacatttcatttggttaagaaaaataatagacttcatttttagtacctccctagtttccaattttcttttttttaaatatatatattttttattgtactttaagttctagggtacatgtgcacaacgtgcaggtttgttacatatgtatacatgggccatgttggtgtgctgcatccagtaactcatcatttacattaggtatatctcctaatgctatccctcccccatacccccaccccacaacaggcccccgtgtgtgatgttccccttcctgtgtccaagtgttctcatttttcaattctcacctatgagtgagaacatgcggtgtttggttttttgtccttgtgatagtttgctgagaatgatggtttccagcttcacccatgtccctacaaaggacatgaactcattattttttatggctgcatagtattccatggtgcatttgtgccacattttcttaatccagtctatcattgttggacatttgggttggttccaagtctttgctattgtgagtagtgccacaataaacatacgtgtgcatgtgtcttta

SEQ ID NO: 119038 - DNA, 448 bp, Homo sapiens
  Payload ID: 3323
  Gene Symbol: C4orf36
  Gene Name: chromosome 4 open reading frame 36
  ENST ID: ENST00000504008
  CDS Start-End: 206-448
gcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtat

SEQ ID NO: 119039 - DNA, 564 bp, Homo sapiens
  Payload ID: 3323
  Gene Symbol: C4orf36
  Gene Name: chromosome 4 open reading frame 36
  ENST ID: ENST00000512468
  CDS Start-End: 185-325
agtaccccggccgcgaccctccgagcccctggagcccgggtaaccaggccgccggcgccggctcgcggggacccgccaccctggaagccccgcgcacacagcgcattcctggtaaagtgaacagagttatctgtgacattccatcaggcacctatgtaacgaaatcataccgtaataactcaccatggcgtatggagtgccaagaaagaacacagtgaaaaccattttgcggggcagttgttataatgtggtctcacactgtcacgcaggctggaatgttgtgcacctcctgggcttgagtgatcctcccatctcagcctcctgagtagctgggaccacaggcacacaccactgtgcccgacaggaaccttgggatattgcattgcttgcaaagacctggtccacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaa

SEQ ID NO: 119040 - DNA, 1215 bp, Homo sapiens
  Payload ID: 3324
  Gene Symbol: C4orf45
  Gene Name: chromosome 4 open reading frame 45
  Uniprot ID: Q96LM5
  ENST ID: ENST00000434826
  CDS Start-End: 86-646
agagtctttcgttctttctggtgcagcttaactgatttgaagaagccgaagaagaaaatccagtagcacggttaagactttagccatggcatctgtatcataccaaaagccaacatctactactgtgggaaaacaaatgatttttacaggtccagactacataaaggattatttacccaaaattcatcagcacacctcctatgtaggagaacagcatctggcgttagaaaaaactggagatctcagatatttatggaggcctgcctcaaatagaagcttgccagcaaaatataaacatgagtacgtcagtgaaattggttggagaataccacagtataattttatcaacaaatcaagactggggagtggctttcatatcaagtatgaagaactaagtcaagcttctcttgattcaataacccacagatatcaaaacccatggcaaccaaaacctcatgtcctggatatgcaaggaaaacagagtcgcgcttcttttgcctggcatatgagtgctttcgaggacactgatcagagaaattccaaatgggctattcttgttaggcagtgtaagtcatcattgccaagagcttccaaaccacctaagctgccgaagctaccaaaaaaggaaaagaaaaggaaacattaacctctaaatcagcataactcaacctgcttttagaaggagaaactgcctactactgtataacaaaaaataagatcataataatccacaagtgcttctcatattgccccaggacagatgtcttgcaagagtacgcttcagcttaaagcccaaataaacagtttggaaaaaaggtgttgtcagtctttgcaaccattaatattgtttcatgaaactaattgttattgactatcatactaatagtagctgtttactgagtgcttataacatctaacactattccaagtgctttacattcattctctaatataatttcataaccataggagataggttctattatttccccagctttgcagataaggaaattaaggctttgaaagagtacatggttaggaagtagcagaacttggatttgaccccaggttatggggctctaaagctaacatatatggcttttaaagtattttataatattggcatggtgctttagcagtaaaaagcagttatatccctaattttcagaagattctcacagcacccttgttgaacaggtactatctttcttttac

SEQ ID NO: 119041 - DNA, 3521 bp, Homo sapiens
  Payload ID: 3325
  Gene Symbol: C4orf46
  Gene Name: chromosome 4 open reading frame 46
  Uniprot ID: Q504U0
  ENST ID: ENST00000379205
  CDS Start-End: 246-587
gcccttcgagatcgattggaggctcgcgcaggagccgtgagttgcctaaggtgaattgactcatatgattggctgtcccgaaaaatgaaacgtctttgtggtccggggctgagacccacgaggagactgggcgggatttctggcgttaggaggcggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgattttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccatttgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttacctgtttgatcctgtcccgttcctccctccccagagtccccagaggtaaccactagagggggcataatatagcatgtgtttttatatttttaatacaaatatattttttaaaagcgctacaaaatattgttttatatatgtggtagccagcttccagatggccccagtgatccctggcctcctggtgttcatgccccagtatagccttctcctgcattttacagtgctgacttttgtaactaccaggatattgagcaaatgcagtgtgtgatttctgaggccatatcttttactcttttttttttttttaagagacaagatctcactctattgctcaggctggagtgtggtggcaggatcatagctcactgtaaccttaaacttggactcaaacaatcctcccatctcgcctcctcctataaagcactgggattacaggcatttttgctcatttttctatgttgttttttttacttgtcagtttttagatattacatattttgaatactaatgatctgttatgtatgttccaattatcttttttagtctggtttgtcttcatattttggttatgaaatcttgaatttttaaaaacgtaattttaccaatctttcataatgatttgctttttctggtttttgtataggaaatgtcataaaaatagtcctattcagccttccaaaagttacaaaatttttgtttttaacatttagatgtttagtccaactgaaatttgttttcttttatggcatgattttggaatcttgttttaattatttttacatatttatagctgttcctccaagtatcaatttttcaagtgcaacatctgtcatgcagttactatgtaagggccagattctgacctttctgttctttttatctgaaggaaatttgaacatgccacccccaaatatgccgatttggcatactgattatttcgagctaaaggtgcttgactaacagtagttgcagaaatggctattttaactgtcctttcctacctgtagcaagccatacaaacttctttgataaagatgctttcctgataccaagatgagaagatggctctaatcagctgagacagcaccagaggaatctacaaacaagaaactattagtttcttaacatatatttaccttccacagtttctgcctctggaagcctaaaactgctttccttcgtcttgtcacacttctctgaaatgtattctttgtggaagatgctatatagtccagagttgtaagccactacttgtgtttaccttttcattgagttttctcctgtgtgatgtacgttgcatatattaataaaattacttgtttttctcttg

SEQ ID NO: 119042 - DNA, 3358 bp, Homo sapiens
  Payload ID: 3325
  Gene Symbol: C4orf46
  Gene Name: chromosome 4 open reading frame 46
  ENST ID: ENST00000508457
  CDS Start-End: 92-289
ggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgattttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccatttgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttacctgtttgatcctgtcccgttcctccctccccagagtccccagaggtaaccactagagggggcataatatagcatgtgtttttatatttttaatacaaatatattttttaaaagcgctacaaaatattgttttatatatgtggtagccagcttccagatggccccagtgatccctggcctcctggtgttcatgccccagtatagccttctcctgcattttacagtgctgacttttgtaactaccaggatattgagcaaatgcagtgtgtgatttctgaggccatatcttttactcttttttttttttttaagagacaagatctcactctattgctcaggctggagtgtggtggcaggatcatagctcactgtaaccttaaacttggactcaaacaatcctcccatctcgcctcctcctataaagcactgggattacaggcatttttgctcatttttctatgttgttttttttacttgtcagtttttagatattacatattttgaatactaatgatctgttatgtatgttccaattatcttttttagtctggtttgtcttcatattttggttatgaaatcttgaatttttaaaaacgtaattttaccaatctttcataatgatttgctttttctggtttttgtataggaaatgtcataaaaatagtcctattcagccttccaaaagttacaaaatttttgtttttaacatttagatgtttagtccaactgaaatttgttttcttttatggcatgattttggaatcttgttttaattatttttacatatttatagctgttcctccaagtatcaatttttcaagtgcaacatctgtcatgcagttactatgtaagggccagattctgacctttctgttctttttatctgaaggaaatttgaacatgccacccccaaatatgccgatttggcatactgattatttcgagctaaaggtgcttgactaacagtagttgcagaaatggctattttaactgtcctttcctacctgtagcaagccatacaaacttctttgataaagatgctttcctgataccaagatgagaagatggctctaatcagctgagacagcaccagaggaatctacaaacaagaaactattagtttcttaacatatatttaccttccacagtttctgcctctggaagcctaaaactgctttccttcgtcttgtcacacttctctgaaatgtattctttgtggaagatgctatatagtccagagttgtaagccactacttgtgtttaccttttcattgagttttctcctgtgtgatgtacgttgcatatattaataaaattacttgtttttc

SEQ ID NO: 119043 - DNA, 1134 bp, Homo sapiens
  Payload ID: 3326
  Gene Symbol: C4orf47
  Gene Name: chromosome 4 open reading frame 47
  Uniprot ID: A7E2U8
  ENST ID: ENST00000378850
  CDS Start-End: 23-952
agtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaacagttttcacactctgccgacttctatgatgcagcaaaactaaagtataagaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactagttaataaatagtatttgctaataa

SEQ ID NO: 119044 - DNA, 714 bp, Homo sapiens
  Payload ID: 3326
  Gene Symbol: C4orf47
  Gene Name: chromosome 4 open reading frame 47
  ENST ID: ENST00000511138
  CDS Start-End: 230-714
cgtgcagaggcgctgcgcagcccaggcgtgtcgcgcgcttgggaaccctcgccgctcccgcagcgcagttaacgtggacaagctggggcaacctggacgagctggggcaacctgatctcggctgtcggagtgggtgtcctcaagaaagtaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaaca

SEQ ID NO: 119045 - DNA, 785 bp, Homo sapiens
  Payload ID: 3326
  Gene Symbol: C4orf47
  Gene Name: chromosome 4 open reading frame 47
  ENST ID: ENST00000511581
  CDS Start-End: 252-785
cgtgcagaggcgctgcgcagcccaggcgtgtcgcgcgcttgggaaccctcgccgctcccgcagcgcagttaacgtggacaagctggggcaacctggacgagctggggcaacctgatctcggctgtcggagtgggtgtcctcaagaaaggtgacttggtcctcgcggacgccaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcgaccctttaatgaggctgcaagcaaaaataaacagatgctacctggagggtccaaagaaatgtcagatcttcaggcaggttattttgatccccattttgtaaggatttttgaaggtgaaggctacataaatctgaatcaagtgaggagacgggatatggtggaagcagccaaaaaaaatctaggcaaagcattcctccctagtaatggagagaaaaagccatgtggcttaggaagctactatggaacaataggtggtccagtcccatttttcagcgcacagtcaaaacctcgagaaaaatacaaggcacctggaaagaatttatacacaaacccgggaaagaaaggaactggatatggctatgcaaatattaccataggtaaacagttttcacactctgccgacttctatgatgcagcaaaactaaagtataag

SEQ ID NO: 119046 - DNA, 832 bp, Homo sapiens
  Payload ID: 3326
  Gene Symbol: C4orf47
  Gene Name: chromosome 4 open reading frame 47
  ENST ID: ENST00000508698
  CDS Start-End: 175-285
cgctcccgcagcgcagttaacgtggacaagctggggcaacctggacgagctggggcaacctgatctcggctgtcggagtgggtgtcctcaagaaaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcatgtggcttaggaagctactatggaacaataggtggtccagtcccatttttcagcgcacagtcaaaacctcgagaaaaatacaaggcacctggaaagaatttatacacaaacccgggaaagaaaggaactggatatggaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttct

SEQ ID NO: 119047 - DNA, 477 bp, Homo sapiens
  Payload ID: 3327
  Gene Symbol: C4orf48
  Gene Name: chromosome 4 open reading frame 48
  Uniprot ID: Q5BLP8
  ENST ID: ENST00000409860
  CDS Start-End: 152-439
ccggggtccctgaaccgcggtaagggcggtggtgcgggcgtccgaatgggcgttttctagatacggggcgcggactagaggctcgctgggcccggagaccggcggactggagtcggggaaccggagggcggccccgctccctctgctggccatggcccccccgcccgcgtgccggtccccgatgtcaccgccgccgccgccgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggca

SEQ ID NO: 119048 - DNA, 433 bp, Homo sapiens
  Payload ID: 3327
  Gene Symbol: C4orf48
  Gene Name: chromosome 4 open reading frame 48
  Uniprot ID: Q5BLP8
  ENST ID: ENST00000409248
  CDS Start-End: 3-389
gcatgcgcgttgcgcgccggacgcggaacgtctgccggtgtccccgcgctgctggtcccggggtccctgaaccgcgggcggccccgctccctctgctggccatggcccccccgcccgcgtgccggtccccgatgtcaccgccgccgccgccgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactgaggaccacgctgctccgtgtgaataaatgcccagtggcacgcctg

SEQ ID NO: 119049 - DNA, 5201 bp, Homo sapiens
  Payload ID: 3328
  Gene Symbol: C4orf50
  Gene Name: chromosome 4 open reading frame 50
  Uniprot ID: Q6ZRC1
  ENST ID: ENST00000324058
  CDS Start-End: 1299-2129
cactcacaatcgatgagcttgcacaggacgtggaggcttgtttccagcagctgtccaccctgcagccgggcagcaggggctggcagtgctcagcctctgcatgtaggggagagaactggagctttgctcagaagtggcacagtggctgggagagagctcactctcagcaggtttggggaaattggggtatttgttctaatgaagaagcgaagtctaaagagagtggtgaaggtgataagccgggaaagaccacggccctgggcaccagcgaagttcctggtaacccagggacactgcctcattgggatgaagccagcccaaaccctccacaggggcctgctgagccctggggtgccctcgagagagtgaggagcaggtttcatcagctcatttctggattgaagaaacagagaagccagattttacatgacaacaccaaacttcacggagaccaagagaggttccatgaaagagtgtgcgcccttgaaagagagagagagagagaggtgacaaaaatatccaggctcgagcgggataaccacaggctggtaggggacatctctcagttaaagaaagaactggatcaatatttacaggcaatctctgaccttgaagactgcaatgggaagagttactgcaaaattttggagcttgaagaggaaaatgaaacactgaaagggaatctgggccaactccagaaagccacgtctgagagtgtcaggaaatccaaagacacgatggagcaagtcaccctggaaaactggaagctccagacactgatctcggagcttggcgtcagttataaagagctgataaaggatatcgtgctaggaatagaagacatgatccgggccttaagtggggagaacgagcaccttctacgcagggtccatgtcctggagagggaagtcaccttgcagaggagcacggatcaggggcgtttggtgaggggaagggagcacctccagggaaaagccaagatgcacgctctagacaaagaggtgcaggtgactccactcacaggacagctgctttcaagagcctgtgggccacccttggaggaggaaatgagtctggctgcagggcagacaggaccttccacaggcaccgggaattccagacgcggtgctgattctccccctccatcgctggtctggagaaacactggtgtagccaatgccctgcaaggaaatgtcagtggagcagaagtgaaagaagcacatttggagaaagaggagaagaggcccaggtgttctgtggctcaggggcaagctctgagctccctgagcaatggccccatgctccgggactcagaggccgaggttactgaggaggatcccaggctgcgggcccagcagctccatcaccgggtgctgaccctgcagtgccagctcagggaccagggcgctgcccaccaggcgtctctggacgaggccacccgcctccaggaggagctccaggccaagcttgaagaacttcagaaaaagcaacatgaagcaaagttggcagtgactcccctgaaggccaagatagcttccctcgtccggaagtgccgggagaggaaccgcctgatcacccacctgctgcaggagctgcacagacatgggctggggaacctcctgctctccgagctggcgcagaacatgctcaacgacgtggcactggctgagtacacggccaccttcctggctccgggagtcccagagacaagccaccacctggacgtcaagtctgagatgacggcagctttaagagctcagacatacctcttgaatcctgaaatggacagtgtcctccaaagctcattgtcttcagagtcctggcctattcccgagccggagtggccagcacagacagcccaactggattctctgaagctccctctgtccttggtgtccacgcttgatcctggaacgtgcctggcagcggtcactgtggaaccaggtctccccgcacaacgtctgcaagaaaaaggcggaatgccctgtcctgccctccaagtcgataacgtcccagcaccctctgagctcctgagcccagcaaggatcctggcttttcaccaagagcttagacaaagcatttgcagcaattcccaggtccataaatcaccgctggagttagaaatgtaatagggccactcattctccggagccatttcatagactccataaatatttgaagcagaaccttcagagagtgctttaagaaattggtagcaatcagagccctcatttagtggcaagtggttttgccttcggctttgggattttgtgttcattgtcagagcttgagagaaacgctggcctgtgcctggcaaattctgaggagtttggctttggcaatgtcaaggcagcataggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatccactccaaaaacgtctgttgatatccactggatgccaggcaatgtggcatgaaggagaagagacaagtcaatgttgatcctggcgccggggacctcacaggacaatgggagagatactcctgtgagtaaatcagcacgcacgcaagtgtcacatgtgccctgagcaacgggatgaaggtaagggtccgttctacttggcttgggacaactggaagtcagccacaaaggaatggctgggcagtgtccggtgggtgaggtgggaagggtgctgctgtacgagggaacgcatgtgcaaaggccctgaggcataaaactgaactgtggatgtgcccctggaggggaagtgggcaaagcatgctcttgtcaagccagctgcaagcagtcactgcatcgttcccatccagcaccccttccttccaccgagaacagagactcgtgccccgaatcaggtgggcgacccaggagaagagcacttctatcctgagggcagccccccaaaaagagagtctagggggcttggacgacacacaccagaccctgacccaggctcacccaccagagatgtcacctctctctttgggaaggggctgaggaggggcttaagggaaaggccaaagccgctacctgtccaattctgtcctctcctggaagtgactgtcccttcatggaaggacaaacaaggacaaggacaaggaactgacggctccccaggaagtgtcaaagtgtatagatttattttaacgtagtttagctttttgtttgaaatgaaaattacacagagttcccgtagactcttccccgggcttcccttgatgttaacatctcatgtgacttatgttgtacaattatagaaactagtgggttttatttcgaggaaaattggggagccattgagacgtaagaaaggcagcctcagcacattgagttccaccctttaaattcgtttatggggttttctgatgggttagcacattcatccatgtattcctggattgatttacccacagatctgtctatttatttatttattcaatatgcatttagtgactgctgtgcgagtgtctggctggatgctgctggggaagaagtgaagatgatgctgtccacctaggttttcagggacccccctggagaccctgtggccccgttaccacccctcaagaatccccagattggaaaccactgcggtgatccctttgttggttcaaccaccccagggcttccctataatttccaagcaggaagtgacctgcagcactggtttggtgatccgccttctgcctccctctgtattttgggacaatgtcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttccaaggcagagccacttattctcccgggccatgaattgccgtctgggtctagcactttgggtcggctcaagctttgtgccgtggctccctggggcacagtacaggatggcggactcccctcgcctggtctgtagaccccagcatttggaagggcacatggtggctccttgccacccatcagatgctccaggggcaggacctgctctggcaacccagtaggttcactttggtagaacctctgtggactccttagttcttccaggttgaatcctgggcagaaatcacatgaaagctgtgaagcacagacatcagtttagaaattgtgtactttcccgctgaatcccaaatgcacaataactgtacaccttgcggttgcatgaatctacaaggtctcctatgcgccctcattcataaactcaaggctgagaatgttggcaggccaagtcctgcccctccccggagtgagctgccttggttcacacgggagtggtccagcgacaggacccgacacctcccctccggaagctcttcagcaggacctgcctcgggtcctggggcagctatcctccggggcctgcctgcagtgaaaccatcagtccgtggagatgttcactggattcctgaccagttgtgggtcgggctcaaccctccctctgggttttcaggatttgtaatgatcgctccatttgtgtaaaataggccggcattttctcttgttactgagatgtatttttctatgtgagttaaatgtataatttgtgtaattttgtacattaaaatgtatgctttttcacaattaaagggtttttttcccttc

SEQ ID NO: 119050 - DNA, 4557 bp, Homo sapiens
  Payload ID: 3328
  Gene Symbol: C4orf50
  Gene Name: chromosome 4 open reading frame 50
  ENST ID: ENST00000531445
  CDS Start-End: 48-2300
ggggtgcccccgaggagcctgactcccaggaacatgagagcaaggaaatgcttttctttgcaggagagacaggtttgccactgtttcccagatttgccttatcagttgaaggggccgaacccactgatcatggtcatccacaggctgtgagcaaaggacacaacaggtgtgcactcacaatcgatgagcttgcacaggacgtggaggcttgtttccagcagctgtccaccctgcagccgggcagcaggggctggcagtgctcagcctctgcatgtaggggagagaactggagctttgctcagaagtggcacagtggctgggagagagctcactctcagcaggtttggggaaattggggtatttgttctaatgaagaagcgaagtctaaagagagtggtgaaggtgataagccgggaaagaccacggccctgggcaccagcgaagttcctggtaacccagggacactgcctcattgggatgaagccagcccaaaccctccacaggggcctgctgagccctggggtgccctcgagagagtgaggagcaggtttcatcagctcatttctggattgaagaaacagagaagccagattttacatgacaacaccaaacttcacggagaccaagagaggttccatgaaagagtgtgcgcccttgaaagagagagagagagagaggtgacaaaaatatccaggctcgagcgggataaccacaggctggtaggggacatctctcagttaaagaaagaactggatcaatatttacaggcaatctctgaccttgaagactgcaatgggaagagttactgcaaaattttggagcttgaagaggaaaatgaaacactgaaagggaatctgggccaactccagaaagccacgtctgagagtgtcaggaaatccaaagacacgatggagcaagtcaccctggaaaactggaagctccagacactgatctcggagcttggcgtcagttataaagagctgataaaggatatcgtgctaggaatagaagacatgatccgggccttaagtggggagaacgagcaccttctacgcagggtccatgtcctggagagggaagtcaccttgcagaggagcacggatcaggggcgtttggtgaggggaagggagcacctccagggaaaagccaagatgcacgctctagacaaagaggtgcaggtgactccactcacaggacagctgctttcaagagcctgtgggccacccttggaggaggaaatgagtctggctgcagggcagacaggaccttccacaggcaccgggaattccagacgcggtgctgattctccccctccatcgctggtctggagaaacactggtgtagccaatgccctgcaaggaaatgtcagtggagcagaagtgaaagaagcacatttggagaaagaggagaagaggcccaggtgttctgtggctcaggggcaagctctgagctccctgagcaatggccccatgctccgggactcagaggccgaggttactgaggaggatcccaggctgcgggcccagcagctccatcaccgggtgctgaccctgcagtgccagctcagggaccagggcgctgcccaccaggcgtctctggacgaggccacccgcctccaggaggagctccaggccaagcttgaagaacttcagaaaaagcaacatgaagcaaagttggcagtgactcccctgaaggccaagatagcttccctcgtccggaagtgccgggagaggaaccgcctgatcacccacctgctgcaggagctgcacagacatgggctggggaacctcctgctctccgagctggcgcagaacatgctcaacgacgtggcactggctgagtacacggccaccttcctggctccgggagtcccagagacaagccaccacctggacgtcaagtctgagatgacggcagctttaagagctcagacatacctcttgaatcctgaaatggacagtgtcctccaaagctcattgtcttcagagtcctggcctattcccgagccggagtggccagcacagacagcccaactggattctctgaagctccctctgtccttggtgtccacgcttgatcctggaacgtgcctggcagcggtcactgtggaaccaggtctccccgcacaacgtctgcaagaaaaaggcggaatgccctgtcctgccctccaagtcgataacgtcccagcaccctctgagctcctgagcccagcaaggatcctggcttttcaccaagagcttagacaaagcatttgcagcaattcccaggtccataaatcaccgctggagttagaaatgtaatagggccactcattctccggagccatttcatagactccataaatatttgaagcagaaccttcagagagtgctttaagaaattggtagcaatcagagccctcatttagtggcaagtggttttgccttcggctttgggattttgtgttcattgtcagagcttgagagaaacgctggcctgtgcctggcaaattctgaggagtttggctttggcaatgtcaaggcagcataggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatccactccaaaaacgtctgttgatatccactggatgccaggcaatgtggcatgaaggagaagagacaagtcaatgttgatcctggcgccggggacctcacaggacaatgggagagatactcctgtgagtaaatcagcacgcacgcaagtgtcacatgtgccctgagcaacgggatgaaggtaagggtccgttctacttggcttgggacaactggaagtcagccacaaaggaatggctgggcagtgtccggtgggtgaggtgggaagggtgctgctgtacgagggaacgcatgtgcaaaggccctgaggcataaaactgaactgtggatgtgcccctggaggggaagtgggcaaagcatgctcttgtcaagccagctgcaagcagtcactgcatcgttcccatccagcaccccttccttccaccgagaacagagactcgtgccccgaatcaggtgggcgacccaggagaagagcacttctatcctgagggcagccccccaaaaagagagtctagggggcttggacgacacacaccagaccctgacccaggctcacccaccagagatgtcacctctctctttgggaaggggctgaggaggggcttaagggaaaggccaaagccgctacctgtccaattctgtcctctcctggaagtgactgtcccttcatggaaggacaaacaaggacaaggacaaggaactgacggctccccaggaagtgtcaaagtgtatagatttattttaacgtagtttagctttttgtttgaaatgaaaattacacagagttcccgtagactcttccccgggcttcccttgatgttaacatctcatgtgacttatgttgtacaattatagaaactagtgggttttatttcgaggaaaattggggagccattgagacgtaagaaaggcagcctcagcacattgagttccaccctttaaattcgtttatggggttttctgatgggttagcacattcatccatgtattcctggattgatttacccacagatctgtctatttatttatttattcaatatgcatttagtgactgctgtgcgagtgtctggctggatgctgctggggaagaagtgaagatgatgctgtccacctaggttttcagggacccccctggagaccctgtggccccgttaccacccctcaagaatccccagattggaaaccactgcggtgatccctttgttggttcaaccaccccagggcttccctataatttccaagcaggaagtgacctgcagcactggtttggtgatccgccttctgcctccctctgtattttgggacaatgtcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttcc

SEQ ID NO: 119051 - DNA, 846 bp, Homo sapiens
  Payload ID: 3329
  Gene Symbol: C4orf51
  Gene Name: chromosome 4 open reading frame 51
  Uniprot ID: C9J302
  ENST ID: ENST00000438731
  CDS Start-End: 1-609
atgtcacactacttctacttgactccacaaattcttctgccctttagccctcttacttctcaagagtttgatctgatcagacgcaaggctggagcatcttggcaggatgaaacacgatggtcagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttcctttttaaataaa

SEQ ID NO: 119052 - DNA, 722 bp, Homo sapiens
  Payload ID: 3329
  Gene Symbol: C4orf51
  Gene Name: chromosome 4 open reading frame 51
  ENST ID: ENST00000511965
  CDS Start-End: 1-488
cagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttcctttttaaat

SEQ ID NO: 119053 - DNA, 2358 bp, Homo sapiens
  Payload ID: 3330
  Gene Symbol: C5orf15
  Gene Name: chromosome 5 open reading frame 15
  Uniprot ID: Q8NC54
  ENST ID: ENST00000231512
  CDS Start-End: 204-1001
atccgcagccaactgtgtggcggtccccactttcgcctagcggcaactccctcctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgatttca

SEQ ID NO: 119054 - DNA, 3612 bp, Homo sapiens
  Payload ID: 3331
  Gene Symbol: C5orf22
  Gene Name: chromosome 5 open reading frame 22
  Uniprot ID: Q49AR2
  ENST ID: ENST00000325366
  CDS Start-End: 128-1456
aatccgaaaacgcaaccgggtgagggagcgcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatctttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttcttttataggaaggtttgtttaattctcatgttctgtgatcatctctttgagaataaaattcagtccctaatagttgaaaagaatcaacttagtaaattatgtcttgcacattccaaataggaaggtatttactttatcaagatgtgtttcatttgtgttctgagtaccagtgaggggataccgtggtacagtgttttgaattgtgtactaatatcattaaagcatgggattttagtggctttttaaaaaatgtga

SEQ ID NO: 119055 - DNA, 978 bp, Homo sapiens
  Payload ID: 3331
  Gene Symbol: C5orf22
  Gene Name: chromosome 5 open reading frame 22
  ENST ID: ENST00000513967
  CDS Start-End: 105-515
gggagcgcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctg

SEQ ID NO: 119056 - DNA, 3117 bp, Homo sapiens
  Payload ID: 3331
  Gene Symbol: C5orf22
  Gene Name: chromosome 5 open reading frame 22
  ENST ID: ENST00000510659
  CDS Start-End: 107-517
gagggagcgcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggttcaccaggctggtttaacctgcgattattcagaacttcctcaccatatcagcacagaacaagaaatagagtgtcttattcaatctgtgcattatttgctgaaaaatttaccaaatcctactcttgtgacaattgcaaggtcaagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgttgtatcttggtttagtaacaggcccttaattaacttatttgtacatgagtcttccagagaacactgttttatattaactttcagttgaaatctttcagatattttgaatctctgaacaaccattgtcagttgtgaatgatggtaaattttttggcatcaagtctcataaccccaactgatagaactgttgcttatctgtcttccttaagtattttttagggttttgtttttttttttgtttgtttgtttgtttgtcttcacttttcccccaggtctgttgagctgtatgagattcattcatacttcatttattcattcaactaatatttgttgaacacttacatgtaccagacattattaagtgctgggtatatggtaatgaacagaatagacaaggcccctgcccttttaggggagacagatgagaagtaaattacgggttatgagaaatgttatgaaggaaaggacaacaacagacatgtcttagtacttagggtatcatggctttataggaaagtaacattctctatctttttttttttttttaattttataaaaatagagatggggtctcaccatgttacccaggctggtctcaaactcctgggcacaagcaatccacctgccttcgcctcccgaagtgctgggattacagatgtaagtcactaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgcgtgctaaataagttaaagggtatgttttgaactatagcactaattaatgtgtgtgatcctagtatgttgatagctttgattttgtgagtggtttactagtcatttattatgattcccatgaactctgatatgattcattgtggttttaactcaggttgaataaaagcatccatttctttta

SEQ ID NO: 119057 - DNA, 583 bp, Homo sapiens
  Payload ID: 3331
  Gene Symbol: C5orf22
  Gene Name: chromosome 5 open reading frame 22
  ENST ID: ENST00000511208
  CDS Start-End: 95-244
ccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatagaattaagtattgaaaattggattatgcctgcagtttatgctggccatttttcacatgtaatatggtttcatcccacatgggctcagcagatcagagagggcagacaccactttttagtaggcaaagacacttctaccacaacaatcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttca

SEQ ID NO: 119058 - DNA, 914 bp, Homo sapiens
  Payload ID: 3331
  Gene Symbol: C5orf22
  Gene Name: chromosome 5 open reading frame 22
  ENST ID: ENST00000504464
  CDS Start-End: 78-488
gccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtaatatggtttcatcccacatgggctcagcagatcagagagggcagacaccactttttagtaggcaaagacacttctaccacaacaatcaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggaagagtacaaaatcttacaagagctgtaccaatttaagaaacctggcaccaacctaacagaggaagatttggtagatattgttgatactcgaattcatcaattagaggatttagaagccactttcgctgatttgtgtgatggtgatgatgaagaaacggtacagagatgggcttcaaaccctggaatggaatcactagttccccttgtacagagtttgaaaaaacggatggaagtaccagactatgaaatggt

SEQ ID NO: 119059 - DNA, 568 bp, Homo sapiens
  Payload ID: 3331
  Gene Symbol: C5orf22
  Gene Name: chromosome 5 open reading frame 22
  ENST ID: ENST00000507818
  CDS Start-End: 99-568
gcttccgcccggagagagctggccgggatgaggcgccggctttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaccattggattctcacgtctatttctgcatttagtccattgccatatgctgttttggttgaaatatatgatgaagattcaggctttcacagagaattaagtattgaaaattggattatgcctgcagtttatgctggccatttttcacatgtaatatggtttcatcccacatgggctcagcagatcagagagggcagacaccactttttagtaggcaaagacacttctaccacaacaatcag

SEQ ID NO: 119060 - DNA, 4270 bp, Homo sapiens
  Payload ID: 3332
  Gene Symbol: C5orf24
  Gene Name: chromosome 5 open reading frame 24
  Uniprot ID: Q7Z6I8
  ENST ID: ENST00000338051
  CDS Start-End: 62-628
aagaaatggggtcagcaggagttccagcatctcagaattgtggtgaaaaccaatacaaaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaa

SEQ ID NO: 119061 - DNA, 5065 bp, Homo sapiens
  Payload ID: 3332
  Gene Symbol: C5orf24
  Gene Name: chromosome 5 open reading frame 24
  Uniprot ID: Q7Z6I8
  ENST ID: ENST00000394976
  CDS Start-End: 229-795
gcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggccaggtttagaaggaagattgtgaataatcccaaagcttcttggttttattttgatatacataattttatggcctgggctttccaaatttgttttcctgtttggtttttttcctgcttttgctcaaaaactgccatatgctgacagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataaataaataaataaataaataaataaataaataaaaccatttattgatgttgctcatttatttggaacgtttttagtttttctcagaaattgtcccattgcattagcacttactgtgttttcaggttgatatctaccaaaggacacaaattgaatggtagactgtaaaactggtataaacagaatgcagtttcccgaccatcagaacccaaatattaagaagcatataggaatccatctatgcatgaaacatgtaaaaaatatgttggttagtttaattaaaaatcttattgtgggtccagtgagaccatctcatccaaaagattttttttcccccaatgatgtttgctttagaagcaagatagaaaggaaaaaaagtattaggtagatatgtatagtagggacagagggaaatctttcttctttcctttctgaaagtaatacttcttgttacacattttatttattgagtttgttctaaataaaatattataaacttcagacttgaaaaaattccacttaactttaaagttacaatgtttgtatttgggattttaaatgcctttgagattaaaatgtagaattgcaggacccaaaaacttttaaaataattaaaattttaaaagagcacatgttgtgttttttgggcttgctattaatgcaaactctgattgcaaatggatgtcatgtttcataccttttttatcaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccagc

SEQ ID NO: 119062 - DNA, 851 bp, Homo sapiens
  Payload ID: 3332
  Gene Symbol: C5orf24
  Gene Name: chromosome 5 open reading frame 24
  Uniprot ID: Q7Z6I8
  ENST ID: ENST00000435259
  CDS Start-End: 264-830
gttcccagccgctgggaagcccctagacgcgccgaggggccgggctacgagcggctgagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaaaagagggcc

SEQ ID NO: 119063 - DNA, 2923 bp, Homo sapiens
  Payload ID: 3332
  Gene Symbol: C5orf24
  Gene Name: chromosome 5 open reading frame 24
  Uniprot ID: Q7Z6I8
  ENST ID: ENST00000504727
  CDS Start-End: 121-588
cccgttctccgcaccgtgcagaggcggcgggctggggagggagcggcgccagcacgaggttcccagccgctgggaagcccctagacgcgccgaggggccgggctacgagcggctgagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggaaaaaagcagcaagccttcaggtgttccagtgatgcctgacacaattgagctggactttatgctgctctttacagtaagaggtgttgcattgtatgtggggactatgtgcactggcgtctaagacagtgacctcaacaatattagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaa

SEQ ID NO: 119064 - DNA, 643 bp, Homo sapiens
  Payload ID: 3332
  Gene Symbol: C5orf24
  Gene Name: chromosome 5 open reading frame 24
  ENST ID: ENST00000508791
  CDS Start-End: 622-643
gggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgagaaaatgatgcatcctgttgccagca

SEQ ID NO: 119065 - DNA, 269 bp, Homo sapiens
  Payload ID: 3332
  Gene Symbol: C5orf24
  Gene Name: chromosome 5 open reading frame 24
  ENST ID: ENST00000507390
  CDS Start-End: 1-254
agccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggaaaaaagcagcaagccttcaggtgttccagtgatgcctgacacaattgagctgga

SEQ ID NO: 119066 - DNA, 2338 bp, Homo sapiens
  Payload ID: 3333
  Gene Symbol: C5orf28
  Gene Name: chromosome 5 open reading frame 28
  Uniprot ID: Q0VDI3
  ENST ID: ENST00000397080
  CDS Start-End: 139-786
ggctccgaccgaggggcggagccgctgctcgagctgctgctggattgaactcagagaagccgggggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctga

SEQ ID NO: 119067 - DNA, 1927 bp, Homo sapiens
  Payload ID: 3333
  Gene Symbol: C5orf28
  Gene Name: chromosome 5 open reading frame 28
  Uniprot ID: Q0VDI3
  ENST ID: ENST00000512085
  CDS Start-End: 296-943
ctctatggctccgaccgaggggcggagccgctgctcgagctgctgctggattgaactcagagaagccggggctatttcgtgtagtggagcccatggcctccaagaagaggaactttctctaccacaagacaaattttggaaaggaatctgattggctcagcctggaccactttcattactagattagtcaccattattagggaaatggaaaactctaattgggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaa

SEQ ID NO: 119068 - DNA, 736 bp, Homo sapiens
  Payload ID: 3333
  Gene Symbol: C5orf28
  Gene Name: chromosome 5 open reading frame 28
  ENST ID: ENST00000506860
  CDS Start-End: 209-736
tcgagctgctgctggattgaactcagagaagccggggtgttgaatgtttgttttctaaaggagacaatgattcataatttgtgacactgtaaatcctgaggtttatagaaaggattcatgactttgtaatggagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttg

SEQ ID NO: 119069 - DNA, 2950 bp, Homo sapiens
  Payload ID: 3333
  Gene Symbol: C5orf28
  Gene Name: chromosome 5 open reading frame 28
  Uniprot ID: Q0VDI3
  ENST ID: ENST00000500337
  CDS Start-End: 333-980
ctcagagaagccggggtgttgaatgtttgttttctaaaggagacaatgattcataatttgtgacactgtaaatcctgaggtttatagaaaggattcatgactttgtaatggagttttgatgcttgagtaacctgcaggagaggatgacactttcgatgtcagagctgcacttgtgggcccaggatttggagaagtggagagaaggtctgatgggagttgaaggagctgcaggtccagcttcttccccatgccagcaagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatttttactgtttttttctatttatctggctttactagtagttcttttagattaacatccagttcattttctggaaatatacctggaatttagtccatttcctaatgaaaaacagctcaaattttagggtaactaatttgtaaagagttaacattatatttggatccaattttcctgagatattgaaatagtgaaatcaccaaataaatgatatgaatcatttaactatacaaatgtatagttaatgctaacatgtatttattttcatatatgttgatcctgagtgaaatttaatttgcagaatgctttatgagttatgattactggcaaaaccttcagagcacttgtgacacatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttggatcataaccgtaacatttgaatttatgcaaaaaaaagaccagaaatgtcatttcaaatgtaaattcctgaatgtaccattaaaattattttagttgctatcagtttgtttatatactattttatatactattctaaaatattttactctgcctgatactgaaagacagcatatatttttttcaaaataaagttttaggaaatttgctttttcctttttctttcaggttgatcttctattaaaatgattcctctttattagagaaggaaaatttagttgctatacatcttatatttgcacagtttattaaagtcagtgccctaaaggtacctgcttttctttgtggcatatatggcatctgctgtcttcagattttcttacacttttgtgatttataatgttagtgattggtgccttattctctgaggaaagatggagggttcataaagcaatgccttatccacagcagattttcttgtatattaagttaaacagaattctgtaaattattatgaaggttcaagctctttaggggagttttttttcttgttgttaacaaattggttgcaatctattatattttgcaattgattagatattacagtctacttatttttcaagagtaattattgtataagtttggttggtataatggtaaatattatatagtgggggtaaatttgattagagttttttttttaagcactggcttcagaaatccatggaaataaagtctgtatcttgtgtaacaattcctgactaaattgcaaaaccttttctactttttctttcttcatattaaacaaataaatattattaaaaatatagggccttatttaagaatgctacatagtgaccggacgtggtggctcacgcctgtaatcccaacactttgggaggccgaggcaggcaggtcacttgaggtcaggagttcgagaccagcctggccaacatggtgaaaccccgtctctactaaaaatacaaaaattaactgggcgtgctggtgtgcacctgtagtttcagctattcgggaggctgaggcagacaatggcttgaacctgggaggcagaggttgtagtgagctgagatggggccactgcactgcagcctgtgtgacagagggagactgtcttaaaaaataaacataaaataaataaataagaatgctacataggca

SEQ ID NO: 119070 - DNA, 721 bp, Homo sapiens
  Payload ID: 3333
  Gene Symbol: C5orf28
  Gene Name: chromosome 5 open reading frame 28
  ENST ID: ENST00000510130
  CDS Start-End: 137-478
gccgctgctcgagctgctgctggattgaactcagagaagccggggtgttgaatgtttgttttctaaaggagacaatgattcataatttgtgacactgtaaatcctgaggtttatagaaaggattcatgactttgtaatggaggctgctttgactctcccgcgaagacctttccttcactgttctactgtgattcccgttgtggttctgaccctgaaatttactatgcaccttttcaagctcaaagactcatggtgctttcttccctggatgttatttatatcctggacttcacatcatatccgagatgggattcgtcatggtttgtggatatgcccatttggaaaaacttctcctttgccattctggctttatgtaataatcacatcatctttacctcacatctgttcattcgttatgtatttaacaggaaccagacaaatgatgtcttcaaaacatggagttcgtattgatgtctgaggtacacggcagtcttagagaagcaaatggctcagatgatgataattaagagtagccaacattaaagttaatttttaaaaatacagttaggtgtttatattatttagttattataattctgcaatcctcttgctcaggaagtgtatacaacttttttaaaaattatacttgttattattctacttctctcttctatgacaactctagtgcaatattagagtttcatttattccacaatatatt

SEQ ID NO: 119071 - DNA, 3049 bp, Homo sapiens
  Payload ID: 3334
  Gene Symbol: C5orf30
  Gene Name: chromosome 5 open reading frame 30
  Uniprot ID: Q96GV9
  ENST ID: ENST00000319933
  CDS Start-End: 309-929
ggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacacacattgttgtgtggtgctttaaactaggtccactatcaacaggctacttactgttcaagaattccactgaagcacttattttaaggccctatttttcttaaacaaaacagtgacaacaacaatcaaaccatttacttttgatgctcattggcattttatgataaaagatgtattcatggcaatgatatgtattcaccctattaggaaacacaactggttacctatgagacctgttctgtccgtgtgcctacgttccttaataatagctaaataaaaatttgtagctttt

SEQ ID NO: 119072 - DNA, 2933 bp, Homo sapiens
  Payload ID: 3334
  Gene Symbol: C5orf30
  Gene Name: chromosome 5 open reading frame 30
  Uniprot ID: Q96GV9
  ENST ID: ENST00000510890
  CDS Start-End: 482-1102
cccttggccgctgttcccgcaccgcggggcagcgggcctggaggcccctttgagaagtagctttccccggccggcggcacctttggctgcgtgcccggccgcgctcagggtgcgactgcccgggtcagatagcacctcagggcgagccccggcggtctgatctcgccgaccctcctcgtcctggttgcaacccgcgtgcgaggccgcccgcgccctccgagtgtctgccggtgcagtgggggtggactggccggctgtggccgtgtgtgcgcgtgtggattggggcccggtccgagccagaagcttaagcggcagatgtcgggcattgccaccctcgccccacctgtcgcgggtggactttggggcagtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacac

SEQ ID NO: 119073 - DNA, 1573 bp, Homo sapiens
  Payload ID: 3334
  Gene Symbol: C5orf30
  Gene Name: chromosome 5 open reading frame 30
  Uniprot ID: Q96GV9
  ENST ID: ENST00000515669
  CDS Start-End: 265-885
ctctccgcctcgtgtctgggccgggcgcacgatgcccgcggtgctggggaaacccggccggaccagcttctgcgatgggcggcggggcggccccagcgtcccttggccttggtggaccggttcccaggcacccgaaggggactggggtctgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaa

SEQ ID NO: 119074 - DNA, 2507 bp, Homo sapiens
  Payload ID: 3335
  Gene Symbol: C5orf34
  Gene Name: chromosome 5 open reading frame 34
  Uniprot ID: Q96MH7
  ENST ID: ENST00000306862
  CDS Start-End: 377-2293
gcggagctctgaagcggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccgacgctgcggcttccagagcattttggcaaatcaaagccagggaccgttgctgggcctcatttccgcaacttttcggctccgaactgcttctttgacttagaagatatcttatcctgccgttgtaatggcagctgaactgcgaatgatactttatgaagatgattcagtacaagtacaatatgttgatggttccacattgcaactttctccctgtggctctgaatttttatttgaaaagtcaccacctgtttcagcacatcctttagaacaaccagaaagaattcgtcaaaggacacattttgtcattagcacttacagagagcaactacagcgagccctagattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataataaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaaggtgttacatatagacttacccatcaaaatatgaactcaatagagatttattctggggatggatctgttttcaaatcagaaggggcttattttgggaactattttacttattattctattcaagaaggatcaggaaagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaattggtctgttgcttctgaacttgaaaagatacagaagtttaacttgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttgaacgttt

SEQ ID NO: 119075 - DNA, 962 bp, Homo sapiens
  Payload ID: 3335
  Gene Symbol: C5orf34
  Gene Name: chromosome 5 open reading frame 34
  ENST ID: ENST00000509489
  CDS Start-End: 277-962
tggccaaaacactctccctgccaccttattcctctagggttgtgatttttttctttcaccaagaaatatcactcgctggtaatttgtcaaactgaagaaacccctgaagaagcagtggtgggcaggcgccgacgctgcggcttccagagcattttggcaaatcaaagccagggaccgttgctgggcctcatttccgcaacttttcggctccgaactgctcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataataaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaaggtgttacatatag

SEQ ID NO: 119076 - DNA, 511 bp, Homo sapiens
  Payload ID: 3335
  Gene Symbol: C5orf34
  Gene Name: chromosome 5 open reading frame 34
  ENST ID: ENST00000503655
  CDS Start-End: 1-380
cttcgcctggtacaaagcacacatgtgtatacacatgggtcaagcagtgctggtctgtggctgcctgtccagaggaatggaaatatcctttgtctttagcacttcattttcataataaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaaggtgttacatatagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctgg

SEQ ID NO: 119077 - DNA, 890 bp, Homo sapiens
  Payload ID: 3336
  Gene Symbol: C5orf38
  Gene Name: chromosome 5 open reading frame 38
  Uniprot ID: Q86SI9
  ENST ID: ENST00000334000
  CDS Start-End: 118-534
cgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccgccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcc

SEQ ID NO: 119078 - DNA, 681 bp, Homo sapiens
  Payload ID: 3336
  Gene Symbol: C5orf38
  Gene Name: chromosome 5 open reading frame 38
  Uniprot ID: Q86SI9
  ENST ID: ENST00000397835
  CDS Start-End: 1-681
atggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagatttgtgttgtcaaaacactggggggatgattgttacctgacaaaccgcctctggcaggacctgaagcctcccagtcacgtcgagaacgggcaggagctcaggttggcgccgccggtgcagtgggcattacagccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataa

SEQ ID NO: 119079 - DNA, 387 bp, Homo sapiens
  Payload ID: 3336
  Gene Symbol: C5orf38
  Gene Name: chromosome 5 open reading frame 38
  Uniprot ID: Q86SI9
  ENST ID: ENST00000457752
  CDS Start-End: 135-347
actaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagccaaagaatttagaacgagtctacgtggacacgcaagtttcagcgagcgggga

SEQ ID NO: 119080 - DNA, 436 bp, Homo sapiens
  Payload ID: 3336
  Gene Symbol: C5orf38
  Gene Name: chromosome 5 open reading frame 38
  ENST ID: ENST00000505106
  CDS Start-End: 38-244
tccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccgccaaagaatttagaacgagtctacgtggacacgcaagtttcagcgagcgggga

SEQ ID NO: 119081 - DNA, 451 bp, Homo sapiens
  Payload ID: 3336
  Gene Symbol: C5orf38
  Gene Name: chromosome 5 open reading frame 38
  ENST ID: ENST00000503940
  CDS Start-End: 38-244
tccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccggtaggcgcggtccagccaaagaatttagaacgagtctacgtggacacgcaagtttcagcgagcgggga

SEQ ID NO: 119082 - DNA, 1441 bp, Homo sapiens
  Payload ID: 3336
  Gene Symbol: C5orf38
  Gene Name: chromosome 5 open reading frame 38
  ENST ID: ENST00000515640
  CDS Start-End: 20-427
gggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcccccaccactcttcctacaaaccacacccccatcctgcacacatcctcttcaggccatctcaacacacgcacacgcacacacacccacgaccacctctccctccacccacagacaccccgttcccacaggctgggccccctgcaacgacccagcggggggtttcaaccttgttgcgactccacatgggacatcctaattcagtccaggacagatatttttaatcaattactatagagctgaaaaacagagagagagagaaagcagccgggttgggcaagccgtcgacagtctgcgacatttttgcgcttcctgggagggaattcctccaagaagaggggtaaatgagaggcccacacgctggatggcaaacacaaacactgtcagatcagatggcaacctttagggttcctttacgatcagatcagtttaaatgaaaaaaaaatcgggtgtaatttttatcaccagggagcactggcctggagtatttccatttctaaagagcggttcccgctgtggtttcattagcatttggggctcatcctccctccccctcccttgacccacccccctccccccgccggacctctgccaggggcagaagagaaaacagccagttattatacaaacatcctcagtttggagctggagtgtctgctctggatacagtcgattctgacatcaattaaatatataaccagacacgtgcagtggcggggagggtcccctcacccagggtgcatctccagaaacgccgcctgcccttccccctctttagctcagtgttgggagtttgaagatggcctcttcccgtcctgtgtgtattttccccttagcaattatactcctccactgaaatctatatgttccataccgctgctgcctgttactaataaaaaccgtctaccttgcactatt

SEQ ID NO: 119083 - DNA, 509 bp, Homo sapiens
  Payload ID: 3336
  Gene Symbol: C5orf38
  Gene Name: chromosome 5 open reading frame 38
  ENST ID: ENST00000505778
  CDS Start-End: 38-445
tccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtgcaagggaaccagttgcaaactgcagtgctgtgcttgaggatggctcctcctgagccggcaggctcccggtaggcgcggtccagccaaagaatttagaacgagtctacgtggacacgcaagtttcagcgagcgggga

SEQ ID NO: 119084 - DNA, 11199 bp, Homo sapiens
  Payload ID: 3337
  Gene Symbol: C5orf42
  Gene Name: chromosome 5 open reading frame 42
  Uniprot ID: Q9H799
  ENST ID: ENST00000425232
  CDS Start-End: 232-9825
ggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctcttt

SEQ ID NO: 119085 - DNA, 11062 bp, Homo sapiens
  Payload ID: 3337
  Gene Symbol: C5orf42
  Gene Name: chromosome 5 open reading frame 42
  Uniprot ID: Q9H799
  ENST ID: ENST00000508244
  CDS Start-End: 95-9688
gtgaatattatgcatcatttatattttattactattattgtttacagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctcttt

SEQ ID NO: 119086 - DNA, 7416 bp, Homo sapiens
  Payload ID: 3337
  Gene Symbol: C5orf42
  Gene Name: chromosome 5 open reading frame 42
  ENST ID: ENST00000514429
  CDS Start-End: 1-6792
cagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaag

SEQ ID NO: 119087 - DNA, 7392 bp, Homo sapiens
  Payload ID: 3337
  Gene Symbol: C5orf42
  Gene Name: chromosome 5 open reading frame 42
  ENST ID: ENST00000509849
  CDS Start-End: 1-5670
cagcagctttgcattttgccccctcatcatgtgaatgttcttcccccacttcatattaaaacagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctgtgtttcagtacatccgctccagatgactggattgactgatattgcagacattattgatgaccttataattaaagacggagtttccagtgaagaacttggcttaacagaacaagctatgggcacctccagcaaatgatgtcttgcttgttaaatttctcagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaag

SEQ ID NO: 119088 - DNA, 1487 bp, Homo sapiens
  Payload ID: 3337
  Gene Symbol: C5orf42
  Gene Name: chromosome 5 open reading frame 42
  ENST ID: ENST00000511824
  CDS Start-End: 1-1487
aaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggttggacatacttatataaatgtgattgacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaagaatcagccaattcctctatggatttattttctaaacctgcagaagtaactccagcttgtctggatggaaaaagcttgagagcaggcattacagaagtgaaggagcctagtgtcacctcacctacaccatcagacatacagcagaacaaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataag

SEQ ID NO: 119089 - DNA, 1238 bp, Homo sapiens
  Payload ID: 3338
  Gene Symbol: C5orf45
  Gene Name: chromosome 5 open reading frame 45
  Uniprot ID: Q6NTE8
  ENST ID: ENST00000292586
  CDS Start-End: 92-1123
agagggttcggagcgcgtgcgtggggcggggccgcggcgggacaaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatca

SEQ ID NO: 119090 - DNA, 1004 bp, Homo sapiens
  Payload ID: 3338
  Gene Symbol: C5orf45
  Gene Name: chromosome 5 open reading frame 45
  Uniprot ID: Q6NTE8
  ENST ID: ENST00000376931
  CDS Start-End: 13-879
gcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcatttctctcta

SEQ ID NO: 119091 - DNA, 902 bp, Homo sapiens
  Payload ID: 3338
  Gene Symbol: C5orf45
  Gene Name: chromosome 5 open reading frame 45
  ENST ID: ENST00000520698
  CDS Start-End: 2-526
gatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggatggctacaaagagatcttattttaaaagcagctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggcccagccctgctgcaaggagcca

SEQ ID NO: 119092 - DNA, 541 bp, Homo sapiens
  Payload ID: 3338
  Gene Symbol: C5orf45
  Gene Name: chromosome 5 open reading frame 45
  ENST ID: ENST00000522157
  CDS Start-End: 13-294
gcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggtgagtcctacaaaacagaaagcaagtggggcgcaggcctgcagcgagcccttccagggagtcccagcatgccacagctgggatcatcctctctcaaacagagttccccagacacggagctcctgcttccgagcttcctgttccttcaggaagtgaaatggatggagcagaatctggaaaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaa

SEQ ID NO: 119093 - DNA, 4145 bp, Homo sapiens
  Payload ID: 3338
  Gene Symbol: C5orf45
  Gene Name: chromosome 5 open reading frame 45
  ENST ID: ENST00000518219
  CDS Start-End: 13-591
gcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaaggtcagtgacaaacagtttctctctggtcccagtgaccactgagcgtgtgtgtgataattctgtcttttgtcacagttgacgaagtgtgcgattcctacccgcagaaagcccatcttcccacccgggtttcttgtcttttctgtctgaagccaactccttcctcgggtctgtacccccttttccctcccatgcctctcgtctcccatgagggtaactcaggaccaaagagcattgtgacccttggagaaactgaggttggccagcaggtcaacctgacgatgggtcagggccatcgtctcattctgcgtggagcacggggacctttgtccgggcaggagtcgtcagcgggccgccctgaatcctgggagatgcttccctccacactcgcatttgccctgctgtggactcttgtatgtgaggcactcttcacttagggtgttgtcttgttcttttttgttttctgagacagggtctcactctgtctacccaggctggagtgcagtggcacagtcatagcctactgaagcctcaacctcccaggctcaagtgatcctcctgcctcagccgccaagtagctgggaccacagatgcacaccaccacactggctaatctttaaaaaatattttgtagaggccaggcgcagtggctcacacctgtaatctcagcactttgggaggccgaggtgggtggatcacttgaggtcaggagtctgagaccagcctggccaacatggtgaaaccccatctctactaaaaataattagctgggcgtggttgtgcacgcctataatcccagccactcgagaggctgaggcaggagaattgcttgaacctgagaggcataggttgcagtgagctgagattgcatcactgcgctccagcctgggcaacagaaaaaaaaaattttttagagacatggtctcactatgttgcccaggcttgtctcaaactcctgagctcaagcaatcttcccacttcccaaagtgctgggactataggtgtgggccactgcgcctggcccatttgtcttgttcttgaagcttccagtccagcaggccccaccgcatatccagtgctgcagagtgcagggtttgctctgcctgtcagaggagccagggcacagcaagggcactgcagttgggagtccactgggcgtcagtcactgcccccacccccacatcagccaaggtcggtctccgctggccttgcaccacgcacagagcactggctcatgccaagaagcagaattcaaactttgatgttgccgccaactagttttgtgatcctgggtaagtaagtggctttgaatctccaaatcctagaagaatgaccagagagtctgccacgggccagtccctgggctgcatgttgtaatggtatcattgtgtttcatgctccctcaagcctgttgctttgttttaaaggtgaggaactgaggcttgcagtttttgtgcagtcatggcaagttcagtggcaaagccaacgtcaagtttcagggccgcagagcctcttctgtactgcctgggtggcagtgctgcagggacccactctatcgctgctttcacattgcttttccctttgtaagcagcacaacccaactgttgttttttttttttttttgagtaggagtttcactcttgttcccctggctggagtgtaatggcacgatcttggctcactgcaacctccgcctcccaggttcaagcgattctcctgcctcagcctcctgagtagctgggattacaggcacccgccaccacgcctggctaatttttgtatttttagtagagacagggcttccccatgttggccaggctggtcttgaactcctgacctcaagtgatccacccgcctcggcctcccaaagtactgggattacaggcatgagccactgcacccagccttttgtttttgagatggggtgtcactctgtcacctaggctggagtgcaatggtacaatcacacctcatagcagcctccatctcccgggcttaagtgatcctcccgagcagctgggatcacaggcactcaccaccacagttggctaattttttgtagaagagggggtttcaccatgttgcccaaactggtgtcaaactcctgggctcaagcaatctgcctgcctcagcctcccaaagtgctgggattcaggcatgagccactgctcccagcctacaacccaactttcttttttttgagacagagttcgctctgttgcctaggctggagtggaatggcgtgatttcggctcactgcaacctctgcctcccaggttcaagtgattctcctgcctcagcctcccgagtagctgagattacaggcgcgtgccaccacgccaggttaatttttgtatttttagtagtgatagggtttcgccatgttggccaggttgatctcgaactcctggcctcaggtgatctacctgccttggcctcccaaagtgctgggattacaggcgtgagccactgcgcccggccgacacccaactttcagagcatctttggttcctggggtgagagaagccagaccccagcaccagtcctatcccacagggagctcggtgctgccacctctgcagctgcagaacccggcaggctctggagagctgccccccggtgggaggtagcagaatggagccagcgcacccctttcccgatgtctcgaggcccttctgctcaaaattcttttgtaggcaccggtaacctgattctaaggtccccaggagatggatcacctgatgacatgagaatgtcttgtttttggaaagcctggtcatgcaatttagcagaaggtttgcggtgaggtggaaggcatttatttgctttgtcttgctaaccctcaaaatcaaagcctgtcccagcctgacagcttccagcagaaagtgtcagaaccagaggcccagccaaggcccaggcagggcaggcggtcctcctgggccctggcattgttcttacacatggagggcatggccatcttctctttcagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatca

SEQ ID NO: 119094 - DNA, 535 bp, Homo sapiens
  Payload ID: 3338
  Gene Symbol: C5orf45
  Gene Name: chromosome 5 open reading frame 45
  ENST ID: ENST00000520995
  CDS Start-End: 44-301
cagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcagagttccccagacacggagctcctgcttccgagcttcctgttccttcaggaagtgaaatggatggagcagaatctggaaaggcttatggtgaaggctctggtgctgattgtagacgccatgtccaaaagttaaatctactacagggacaagtttcagagctgccactcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccg

SEQ ID NO: 119095 - DNA, 1096 bp, Homo sapiens
  Payload ID: 3338
  Gene Symbol: C5orf45
  Gene Name: chromosome 5 open reading frame 45
  ENST ID: ENST00000523084
  CDS Start-End: 352-981
cgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatca

SEQ ID NO: 119096 - DNA, 503 bp, Homo sapiens
  Payload ID: 3338
  Gene Symbol: C5orf45
  Gene Name: chromosome 5 open reading frame 45
  ENST ID: ENST00000523835
  CDS Start-End: 13-204
gcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcagactgttcagtcagattctctgctccaagtccatagaatctcattccaagccaactggaagagctgagtctcaattataaattcctaggagaagcaacctggttggcccaggctgactcggatgcccacctctggtccagtcaactgggattgggtctcagaagagaggggctggcttaccaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctca

SEQ ID NO: 119097 - DNA, 868 bp, Homo sapiens
  Payload ID: 3338
  Gene Symbol: C5orf45
  Gene Name: chromosome 5 open reading frame 45
  ENST ID: ENST00000521299
  CDS Start-End: 49-297
aaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggcc

SEQ ID NO: 119098 - DNA, 410 bp, Homo sapiens
  Payload ID: 3338
  Gene Symbol: C5orf45
  Gene Name: chromosome 5 open reading frame 45
  ENST ID: ENST00000521333
  CDS Start-End: 22-363
ctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcagtgccggggagctgaggggtcctgggaaggagctatggagtcccatccagcaggttacagccacatcctctaaatgggcgcaatttgtcctgccacctagaaaaagttcacatgtggaca

SEQ ID NO: 119099 - DNA, 2879 bp, Homo sapiens
  Payload ID: 3338
  Gene Symbol: C5orf45
  Gene Name: chromosome 5 open reading frame 45
  ENST ID: ENST00000522663
  CDS Start-End: 65-322
ggggccgcggcgggacaaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcagagttccccagacacggagctcctgcttccgagcttcctgttccttcaggaagtgaaatggatggagcagaatctggaaaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggatggctacaaagagatcttattttaaaagcagctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagaaactggcccgtacagagacctgcaattctacgcaagcttaacacaactatgagacagaagaggggcacgcagaagaggtgggcaaaagtggtcacaacggcgggggatgctttgaatactggatggtgtccagagccgctccgatgtcatagttcttggtctgcaggagcctggtgagccagccgccttcatcagagaagcccatggacagcatctgggagagggactcaatcagccgcgggtcagcctctgccgaaacagtaaggaagccatgaggagtggtgctgagccctgtgagtgacccgaaacacataccctgctgccttggccagccaggaccagggtctgccagtgtccgagcctgcccagagctctcgtcctcacaggccacagtggacctgctttccctgtaaagggccaagcagtctttttcacactgctcaactctgccactgcgacaccaggcagccaggtggtgtgtaagcagaaccatcaatggacactgaaataggcatttcacctgtcacatcttttgattttaaaatgtaagaacaggccagttagccaattattacactcctccatgcaagagatgatggggcattgaaatagattgaagatggagagagatgaatggatacaagatacattttggaggtagaatgaacaggacttggaaatgtatgtggagaaggcaaaggagttaaagatgatatctggagcagcacaactcacaattgcaaagatgtggaaccaacctaactgcccatcaagcaatgagtggataaagaaaatgtggtatatatacaccatggaatactactcagccacaaaaaggaacgaaataataccttttgcagcaacttggacggagctggaggccattatcctaagtaaagtaattcaggaatggataccaaatatcatatgttctcacttatgagtagatgctaagctatgatgatgcaaagacataagaatgatatagctttccctctccctctttctccacggtctccctctgatgccgagccaaagctggactgtactgctgccatctcggctcactgcaacctccctgcctgattctcttgcctcagcctgccgagtgcctgcgattgcaggtgcgcgccgccacgactgactggttttcgtgtttttttggtggagacggggtttcgctgtgttggccgggctggtctccagctcctaaccacgagtgatccgccagcctcggcctcccgaggtgccgggattgcagacggagtctggttcactcagtgctcaatggtgcccaggctggagtgcagtggcgtgatctcggctcgctacaacctccacctcccagctgcctgccttagcctcccaaagtgccgagattgcagcctctgcccggccgccaccccgtctgggaagtgaggagcgtctctgcctggccgcccatcgtctggaatgtgaggagcccctctgcctggctgcccagtctggaaagtgaggagcgtctctgcccggccacccatcgtctgagatgtggggagcgcctctgccccgc

SEQ ID NO: 119100 - DNA, 579 bp, Homo sapiens
  Payload ID: 3338
  Gene Symbol: C5orf45
  Gene Name: chromosome 5 open reading frame 45
  ENST ID: ENST00000519213
  CDS Start-End: 49-333
aaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcagagttccccagacacggagctcctgcttccgagcttcctgttccttcaggaagtgaaatggatggagcagaatctggaaagactgttcagtcagattctctgctccaagtccatagaatctcattccaagccaactggaagagctgagtctcaattataaattcctaggagaagcaacctggttggcccaggctgactcggatgcccacctctggtccagtcaactgggattgggtctcagaagagaggggctggcttaccaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagca

SEQ ID NO: 119101 - DNA, 1244 bp, Homo sapiens
  Payload ID: 3338
  Gene Symbol: C5orf45
  Gene Name: chromosome 5 open reading frame 45
  ENST ID: ENST00000518235
  CDS Start-End: 11-700
acaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggatggctacaaagagatcttattttaaaagcagctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagaaactggcccgtacagagacctgcaattctacgcaagcttaacacaactatg

SEQ ID NO: 119102 - DNA, 556 bp, Homo sapiens
  Payload ID: 3338
  Gene Symbol: C5orf45
  Gene Name: chromosome 5 open reading frame 45
  ENST ID: ENST00000524068
  CDS Start-End: 14-286
tgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggagaagcaacctggttggcccaggctgactcggatgcccacctctggtccagtcaactgggattgggtctcagaagagaggggctggcttaccaggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaa

SEQ ID NO: 119103 - DNA, 662 bp, Homo sapiens
  Payload ID: 3338
  Gene Symbol: C5orf45
  Gene Name: chromosome 5 open reading frame 45
  ENST ID: ENST00000519208
  CDS Start-End: 43-291
agagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggcttatggtgaaggctctggtgctgattgtagacgccatgtccaaaagttaaatctactacagggacaagtttcagagctgccactcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaaggtcagtgacaaacagtttctctctggtcccagtgaccactgagcgtgtgtgtgataattctgtcttttgtcacagttgacgaagtgtgcgattcctacccgcagaaagcccatcttcccacccgggtttcttgtcttttctgtctgaagccaactcctt

SEQ ID NO: 119104 - DNA, 559 bp, Homo sapiens
  Payload ID: 3338
  Gene Symbol: C5orf45
  Gene Name: chromosome 5 open reading frame 45
  ENST ID: ENST00000523737
  CDS Start-End: 49-204
aaatgcagagcgcacgcgcttggctgcctggcgactgcacaagcagggatggcgtcgcttcagcgttctcgggtgctacgctgctgcagctgccgcctcttccaggcgcaccaggtaaaaaagagtgtcaagtggacatgcaaagcttgtggagagaagcagtcctttttgcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaaggtcagtgacaaacagtttctctctggtcccagtgaccactgagcgtgtgtgtgataattctgt

SEQ ID NO: 119105 - DNA, 810 bp, Homo sapiens
  Payload ID: 3338
  Gene Symbol: C5orf45
  Gene Name: chromosome 5 open reading frame 45
  ENST ID: ENST00000610475
  CDS Start-End: 220-696
aaaggactcccaagaactggagctggaaggaacaggagtgtgtttcagcaaacagccttcatccaaaatggaggagccaggcccccgcttcagtcaagacctgcctagaaaaaggaagtggagcaggagcaccgtccagcctccgtgcagccgtggcgtgcaggactcgggtggctctgaggtcgcctggggaccccagaagggacaggctggcctgacatggaaggtgaaacaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatc

SEQ ID NO: 119106 - DNA, 506 bp, Homo sapiens
  Payload ID: 3339
  Gene Symbol: C5orf46
  Gene Name: chromosome 5 open reading frame 46
  Uniprot ID: Q6UWT4
  ENST ID: ENST00000318315
  CDS Start-End: 2-265
aatggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtgacatcctcaggacacacccatgtggctcctggacaatccaagagcagccaaatcctgcttttccagtttggctccacaagtcctccaggacagagccctcaaagcaactcccaacgagttctcaggattcaggctctggcttcaaccaaacagaactcattttgaacaccctgactgcatttttgcttttagaaagttagaataaatatggcgctttgggatcacatagttgatggagagga

SEQ ID NO: 119107 - DNA, 573 bp, Homo sapiens
  Payload ID: 3339
  Gene Symbol: C5orf46
  Gene Name: chromosome 5 open reading frame 46
  Uniprot ID: Q6UWT4
  ENST ID: ENST00000515291
  CDS Start-End: 38-256
gaacaatttatctgcacgaataccccgtgctaccagaatggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgtaagcactgagaaaaacgttgctttttgtccaattctctgttgataatgaccacacaatgacctcatggcattaaaatacatgagaaacaaaatttgtggcataagtaaatgtgttatttttcattgaaaaatgttgccctacttaaaatatattttgcatctgaatcaactgccctgagctttttgggggaaaggacattcccatcaagtggttccatacaggatttttttttttttttctttttaatctcaggagcaaatagggaggaggaagaacactagactaaggaacaaaaagccaagttctgatcctaactca

SEQ ID NO: 119108 - DNA, 2522 bp, Homo sapiens
  Payload ID: 3340
  Gene Symbol: C5orf47
  Gene Name: chromosome 5 open reading frame 47
  Uniprot ID: Q569G3
  ENST ID: ENST00000340147
  CDS Start-End: 106-636
ggtctggccctaaccgctcccgcatccctcgcctgcacagtgggcagtctggcgcctgtggcgtcgtgtttgctgagggcccggctgccgttgactgaggctgcgatggcggcggcaggccggggtcgggagcaggactcggcgcgcttcgtctatgtgacgcgcttcggctcgcatcagtgcagtggcgtcctgcaactgggcggccgtggagctcaaggcctttggggtcaggggcctggggcaggctgtcgccaggagaagccgagggaagcaatggcggtggcgggcgttcagggtggcagcgagctgcccctcggttcccagctcagggtccccacgacccctggtgtggaggctgcggcctctgcctcctcccagctgcgggcatcgagagttcagagcggcaccagacagtcggcgcgtgcaggtttaatccagaaggatgcagctaaaaagtatgattttcccataccattgaatgaagcttccaaaataatgaagaaaaagaaaaaggttttagtatggaatagagtatacaaagtcatttcaagaatgcttgaagaaaatgaaaaatatagacacaggctgaaatgccaaaggttatctagtgaaagctcaaattacacaagatgaatcttcttatcttctggaataacctatctttggatgtttcccaaagaagagtatgaagaatctaaagatgaaacattaaatgaatcataattatttgttaattttgatgtgttttattagaattgggactttagtagtcgaacagaaaaattaccttctttataaattaataatatttctttgctacttaataatacctttagttaaatattgttaaccatatgcatgcaagtgttattttcagaattaatgcttattctacatacttttaaattaacctcatacataaaattaaattagcatatcaatgcaattgcatgaattttataattaccagcttttccattttattaatgagtctacaactgctgctttgttcatctcttcttttagatgtaactcttaaattaaacttggattcatttaaattatttttggcttcctctaaacttctcaattattttatggaaaaaaccttagaatttacatagcaacgattattttgggtgttaaaactaagctaatgattatttaagccatcttttcatcctaaggaaaattagtaaatgtatgcatttataatatggatatattataatggactatattataatatggagtattttaggaaaatttttgggcaaagatcagaggagatgccctttaccttgccaggcccctaagtaatacattatttttaagtcaatgaatgagaggattagaattctgaaaatcatttagaagtattgtttaataagtcctttttttctactcaacattaagtagtaatcaacttttacctccgccagtttttctgcttttttgctggtacgatctctctttctaaattgaatcaaagacctaggtggaactggaaacttaggagggaaagacaaaatgaggcttgttcatgatcaaattctgtgtactctagttgcttctttcccttggagtgacaggtacttttatatccaggatgattacagtgatgacatccattcttttttgggggcattgagaaggtgggcttcctaattattttacaaaggtattacaaagtgttaatatacaaaattctcatgaaatagtacaagttgtaaggactgtaaagtaattcatagttttgttttttcctctaatagttgtaacttaattacttcaggagactacgacagtgtagaatttgtggtaacatgatcttctagtgactatttatcaaatccacctgtttctagatgaaggacacattgcctggggaaatggcctcggtttttttgccatgtaggctctcaagtttccctgcattgagggtcacacaacttctttatattatgctgggtaaatttcaggctgctaaatccttgggtgaagcttcaaattttagcttatgcaactgaagtccattgcaaaatgagacatatttacactgtttatactgtaatttatgctgcataaagttttgtagtgaatgtgtatgagagttttaggtttgcttcaatgtatgtttatatttatgtgacttatacaacttgacatagtagtctgttttaatttattaggtatatcaatatttgttagatttaaaataagagtctaatgctggatacaaactcagtttatttcactgttctagaaccatggaggaatgaagactcccactgaaatgaatgttctaaatatttgttctaaatcttttaatttttgtttaataatttctggtgaatatgtgttcaatctgttatgttaaatagaatataataaacataagacttttctttactgatacatcactgaacataagctgcaatactttaacttatttctgttccataatttcagtaggggctaatgacccacccctgctacattaaagacttcagactgca

SEQ ID NO: 119109 - DNA, 2385 bp, Homo sapiens
  Payload ID: 3341
  Gene Symbol: C5orf49
  Gene Name: chromosome 5 open reading frame 49
  Uniprot ID: A4QMS7
  ENST ID: ENST00000399810
  CDS Start-End: 470-913
ctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaggagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaaggctgagtgactcctaagtatttctttatttttttgaaaacagtttttcagtgtaggtgtcttttatttatttcaaacaaatggcagtagtttatttcgaatgcctttgggtgcattataccatatttatagtaacataatagaaaatatataaagtttgggttatagaaatatttataaattattcattattcagacttgatttcaacaaagacaaggcatctgtaagtgactgtaataaatcaaagtcaaactaaa

SEQ ID NO: 119110 - DNA, 1020 bp, Homo sapiens
  Payload ID: 3341
  Gene Symbol: C5orf49
  Gene Name: chromosome 5 open reading frame 49
  ENST ID: ENST00000509627
  CDS Start-End: 131-568
caggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaa

SEQ ID NO: 119111 - DNA, 5241 bp, Homo sapiens
  Payload ID: 3342
  Gene Symbol: C5orf51
  Gene Name: chromosome 5 open reading frame 51
  Uniprot ID: A6NDU8
  ENST ID: ENST00000381647
  CDS Start-End: 20-904
gcacccgccgattgtggccatggcggccgcagtctctagtgtggtgagacgagtggaagagctcggggatctggctcaggcccacatacagcaacttagcgaagctgccggtgaagatgatcactttttaattcgggcctctgcagcattagaaaaattgaaactcctgtgtggagaagagaaagaatgttcaaatccatcaaatcttctagaactttacacacaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaacactgcaatttgcttggggatgagctactggaatgtctctcttggagacgaggagccctgctgtatatgtattgtcattctcttaccaaaagaagagagtggctcttaagaaaatccagtttgcttaaaaagtaccttcttgatggaatcagttacttgctacagatgctaaattatcgatgtcctatccagttaaatgaaggagtttctttccaagatctagacacagctaaattactgagtgcaggaatatttagtgacattcatctgctggctatgatgtacagtggagaaatgtgttactggggatcgaagtattgtgctgatcagcaaccagaaaatcatgaagtggatactagtgtgtctggagcgggctgcactacatacaaggaacccttggatttccgagaagtaggagaaaaaatcttgaaaaagtatgtatctgtgtgtgaaggacccctgaaagaacaagaatggaatacaacgaatgcaaaacaaattttaaacttctttcatcatcgctgtaactagtaagttcatctagtccttttcaaatagaaaaacaacaaaacccatgaaatggaaaagagagttccaaaaaagaagacctgttgatactgaatatgagaacattacactgcataaagatatccagcttgggtaccctactaaaacaacatcaccatctttttcattatatattagtaaacctatgaagggatgattctttaatttctaaagtgttgttcaaactcaccttaaaatacagatgttatgtcactaataatgagtagtaacccaatttagctttacaaagattttttctattactttttttttttattgtggtatatgtaacacaagtttaccatttttatcatctttagattatttttaaatctcactaccttgaagtttgccatgcttcagaaattaaagtcaagttacttcactgctttgaatacatactatggatataaatgtaggcaaaatgaaagattatgactaatattcagattccattttcaataaggtaaataatgaaagatctcacaaaggaatcattgtgtttaattattttgccatgtattactaattgtatttaaaatttctacttcccttaggcattttataaaaatttaaaaattatttttctattttgtttaaaagacaatgcatggcttttcaagtgagtaatgaagataaaaaccaagctaggttagtctaccattagttcatatgtttttgtagcacatcttttcataacatactgaaattttaatgttttttgcctttaataataggggtgagtgttaaaggccagagagcctaacttgatatcttgctcatggtctttctgtctacctcaactcctgttgtcatctttggatgatctttctgataccttgctgataccttggacttctgcccagtgactttattacattccagcagcttactcccgtggccgcactttgaatgtcaccaccttgagtttctctttctggtaaaatttcagtaactgataactgccctcttttcagttttttcacttccttattttattgacttttctctcctttatgctcattccacattcttcagttccttcttacccccttttcttgactgctccccttcctcctaaactgtcagcccctttcaggctttcttccctatccaccctcagctttatgggatactatatgaactaatctcaccagttattcttctttccctggtcttttagtctagtcctttggcaagccctcaacctcagattaatcctatttattatctaccttttcggggatgctgagttctttgtgatgggtagtccttcaaagtagaatcactacaagtgtctcacttcagccttagaaaagccctcaatgtaaaccttatgtttgttactagggtggcctctctcccatttcccgctgtggctgagccaaacttcattactttccttaggccctctgcccctcccctagcatatggctctttctcctattgaacagaaaattgagactatgaagaggtcaacttgtatttaccaactttactcattttcccattttagaggaaaagaggttgcctgcttcctatcaaaggcgactctgtgctacatgttggtttcatcttcgctgtctctctcatttccccacaaagtgttgtctcactttctgcctaccttttaggtattgatcttcactatatttttttctctctctctcttttttttttttactttacatattttatacaatgtcattcataactatggcttcttttaccacctgtaataacagactgagtctcaaacctgtaacttgtatcctgacttatctcttgctttctaaaccttgtttctaactgtctatcaaatatcttcattagacatcccacagtaattttaagctcagtgtttccaaacgtcaagtcctcatctgttatataaaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacaccccta

SEQ ID NO: 119112 - DNA, 1391 bp, Homo sapiens
  Payload ID: 3342
  Gene Symbol: C5orf51
  Gene Name: chromosome 5 open reading frame 51
  ENST ID: ENST00000612065
  CDS Start-End: 1-459
atggcggccgcagtctctagtgtggtgagacgagtggaagagctcggggatctggctcaggcccacatacagcaacttagcgaagctgccggtgaagatgatcactttttaattcgggcctctgcagcattagaaaaattgaaactcctgtgtggagaagagaaagaatgttcaaatccatcaaatcttctagaactttacacacaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaacactgcaatttgcttggggatgagctactggaatgtctctcccatttcccgctgtggctgagccaaacttcattactttccttaggccctctgcccctcccctagcatatggctctttctcctattgaacagaaaattgagactatgaagaggtcaacttgtatttaccaactttactcattttcccattttagaggaaaagaggttgcctgcttcctatcaaaggcgactctgtgctacatgttggtttcatcttcgctgtctctctcatttccccacaaagtgttgtctcactttctgcctaccttttaggtattgatcttcactatatttttttctctctctctcttttttttttttactttacatattttatacaatgtcattcataactatggcttcttttaccacctgtaataacagactgagtctcaaacctgtaacttgtatcctgacttatctcttgctttctaaaccttgtttctaactgtctatcaaatatcttcattagacatcccacagtaattttaagctcagtgtttccaaacgtcaagtcctcatctgttatataaaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctg

SEQ ID NO: 119113 - DNA, 686 bp, Homo sapiens
  Payload ID: 3343
  Gene Symbol: C5orf52
  Gene Name: chromosome 5 open reading frame 52
  Uniprot ID: A6NGY3
  ENST ID: ENST00000409999
  CDS Start-End: 63-542
cacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttccagcgccacctcgggttcgaactaccagcgcgatagactcggccgccgcccagaaatcggcgtagggggtcagccgcagatctgctttccgcggccgaggtccgcgcagcagccggtgctgttcagcttaatgaattccagtgaagcagcgatgaaaaaaactttacccaagagccatttatctcgggtgattattcatgataaccgcatcacacaacgaatctatgagatggaggtgagcgctttagagaagaccaagaaaaagatcagccactactatgaacacctgaaaaaaaagttcatgacagagcagctcagaaagctcgggcgatggagagaggaatccgtgaacagcaaccggtacttaaccttcgggataccaccaccagtttaaactccagtctcccaagaaaggccaaccaccctagttctggcaaagggatctgccccagggtcacgatgacaccagtgtgacccgaggagaactagtaactacaacctacacaactgtagaacaataaacagaaaccagcagaca

SEQ ID NO: 119114 - DNA, 4767 bp, Homo sapiens
  Payload ID: 3344
  Gene Symbol: C5orf56
  Gene Name: chromosome 5 open reading frame 56
  Uniprot ID: Q8N8D9
  ENST ID: ENST00000337752
  CDS Start-End: 132-512
agaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagggaatcttcaaactcttcttctccactggctcctgctgtgctcctgtctccatcacctgtataatgcttcctgccatcctgccttccccgtggagtacagccatgctgtctgctgcttacagccaagattctggaaagaaatgtctcctttttcctcgtcatcaaccactcatttattcagcaagtgtttcttttacacttgcctgtgctgggcatggcagcaatgcagcagtgaacaaaaccatcagccctgctctcatgcagcttataatcaagtagagagacagacataaatgattaatagatgctcctgtaatggtggttgtgaggtgtgctgccacagcccagccacacacgccagttcccttctctgcacatgtacatgtctgctcatccttcccacctgaactcatgtgccacctcacttatgccccttcccaatgccgcacccacacaacagggtgtccctctgtgcccacagcagcccttgggtataactgttccccacagaggctgaaccccaagggcagagtccaggccacactcaccacggagacccctgcctggcacagagcccagcccagcagagatgctcagaagatgaatgaaagtccctgctgagattgatccaatctgtttgtgaacatctctggggtccaagaattcacggctttctttttctttagagagccttttgtttctttttgccattatatactatatttgggttagggcacaacaatgtgaatatacttaatactgaactctacacttgaaaatggttaagatggtaaagttttaagttatatgtattttgccacaattttttaaaatgcagagcataggtacaaagaaggaaaaaaagggggcaaggtccattttattgagaaataaagaacaaagggttcaattcagagaggattggattttaaaacgtaatttagattagggaaatgcaaatgaaaaccataataagtaagataccacttcacatctgttaggatggctattttaaaacaacaaaaacaacctgaaaataagtgttggcaaggatgtgaagaaatagatacccttgtgcattgctattgggaacgtaaaatcatgcagcctttgttgaaaacaatgtggtggttcctcaaaaacttagttatcatatgatcccgcagttccacttctaggaatatacccaaaagaattgaaagcagggactcaaagtgatatttgtacaccagtgtttgtagcagtattattcacaatagccaaaaggtggaaacaacccagatgtccatgacaagaggagtggataaacaaaatatggtgaatatgtacaatggaacataattcagctttaaaaaggaatgaaattctggtacatgttataacatagatgaaccttaaaaacattatgctaagtgaaataagccagacacagaaggaaaaataccagatgatcccacttatatgaggtacctagaatagtgaaattcatagagacagaaagtagaaggatggttgccaggggctggaaggaggaagaacagggagatactgcttagtggatgcagagtttatgttgagggtgatgaaaaagttctggagatggatggtggtgatggctgcacaacagtgagaatgtacttcatactatggaactctgcacttaaaaatggttaaaatggatgtagacattttatgtctattttgccataacaagaaagtaatttgggtgtattttagagattttagaaaatactgtaagcacaagaggaaaaaaattaaaatcattcgcaatcaccaggtagagacaacgactgttgaaagatcagtgtgtatcttttcattctcgttctctctctcaaaaaagtgtgtgtgtgtgtgtgtgtgtgtcttcagatgtcacactggactttcaggaaaggttcccctctctgctgcttccctgctggagccatggagagcaagtctatccctgttccataggtcaatcctttgaatgatttctcatggctgagttcactcccctgcacctccagggttgcacttctctgaaaatactcatttattttatgtgtctactaaaaacatggcacccacgacccaataatatgttggaaggggttggagagagaaacgcgagtacctctcacaccttctcacacactacacatcttagcgatggccgagtgagcatgttggctctctggactcctcagtctgttggtctgggctgcgccaggctcaggctccctgcctcccccccaaccttgatccccttgcttcttgaacctgatgctgggcctcacattctccgttgattctagctcttaaatcctgcttctccagcttgtcaggaggctgtgccctcacaccccaaagagcagatctgccctctccactgagagggaaggagtgaaggtcccacagcctctgacccctgctgggcccaagagaggaacagctgcttgctttatttctcgtgggagaagtgtgtctcctctttgtctcaggcacccctctgccctgtacagcagcaagtcagcaggaatgagctgagccgcccaagtagtggctccctccactatgggggctctgtggtcctgggggctgtcctgcctccactgccataggcctggccccagagcatgctgcagtggtcacaacctgtggaggtgcccccagacccccatatttgggcccaactacagcctccttccccagctttgccacctggcttgggagccagggcaccaccagcttcactggcagggagagatgaagaaagaggccatagccacgcaagtgactgaagttcatgttcgtgcacaccaattagagagggacagcacgttcatttacctccaaatccagccacagacacatcgcccttttctcttggctctgaggcctccacagaagggttttttaaggttgcagccaggacctttatagcctagtcctgagaagattatctttttattgcaactttgattaatgattgatcaaaaactgatactagaaacactgaagaacaaatttgctgtagacattaggaaaggtctacatctggcaggcctggagacctgcccaccctctccccccacggtcaaaccagggcaaaggtacattggaagacccaacccctacacactcttacacgtgcactcgcacacacacactgaggggaaagaaatatttaattgtccttaaatcctcttggattaggctataaattgcaaataaatggagcaacagacagagcaaaagcacataaggtcctttaatagaatttctctatcttattctgtttctatgaatgcctgttacaaattagcagcttaaagggaaacctggagtgtgggaaagagcgacccttgtgtgaagtccacagccggggtttcctacagacctcaggtcccagagaacatctaagatgcctccaacaccagatggaggagggcaggagatgctgcacagagaagcagcacttcccgagcatctgtggcaggaagtgacttggagaggatgaggccgtgcctcaggtgtgctctagctgttctgatggtctctgaggccacgactgccatggtgaggtccacagcctgcatcagaatcaccaaagggcccaaacgtacggcctcagagcctggagagccaggaatcggcattgcaacaactccctgctcagtgggttctaccagtccagtacctgccctctgagggtgcccagggagcagggtgcttgctggctggaacactttttcctgcccctcagctcctctgtgatgccctgaggcacgggcactggaaagctggcagagctgcttctaaattgaaactggaaaatgaaactggaaatcacagtttcattttccagtttcactcgctccccctactgttggggtttcttttccacaaggagagtcccccagggagaaagaagcaggagtgggagtgggggagcatgttgggggaaggcagtgagggtgtcctgtctgcagcagggcatggaggggccccagcgctgcacttgcttcctttaagcctggcctgcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctgaagcgactggaatgcggggaaggagggcagtcggggagagccgagaaccagcccccctgccaactccaccccattcctctcctcacctgaaatgtctcatccttagaacagctgccctaaccccctaatcccacacactcctttgtaggttaagacccctgaagttgcaccctctcgtaggagctatgtttttcagagatccatgtgattatttgcctaatgtctgcctccctcagggaagtaaagtctgtgacgcgt

SEQ ID NO: 119115 - DNA, 621 bp, Homo sapiens
  Payload ID: 3344
  Gene Symbol: C5orf56
  Gene Name: chromosome 5 open reading frame 56
  ENST ID: ENST00000378947
  CDS Start-End: 124-366
gcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagcctacgccactctgtgccctttagccaaggaagcccagctgaggccccgcagcgtccctgcccagcagagctacaggaggcccgaggccccttcctgttcactcttgctctatagacgccacgctgcaaagcagatgtgcagggacaccacctgaagacccagcctgcagctcagccctacacactgtggatggtggagatcccagagggccaagagaagcttattgagacttctctgcactgcccctcccacagcaggaggttcatggcccatgcatttctgggagggttgacagggcccaggttgtggaatacctgtctgtgagccccatgtcctgtcttgtcccagctgcctgtagtttgacagagtatgctagaggtcagccattgctagggaggctgccactaac

SEQ ID NO: 119116 - DNA, 942 bp, Homo sapiens
  Payload ID: 3344
  Gene Symbol: C5orf56
  Gene Name: chromosome 5 open reading frame 56
  Uniprot ID: Q8N8D9
  ENST ID: ENST00000378953
  CDS Start-End: 477-830
gcgccgcgggcgcctttccacttacggcgggcctgcccagcctcccgcccagcccgggcccgggtcccgccgaggcaggtgtgcgtggcggactagctctcgggcactcggctggcccagctccaccccgaacgccaccgggccaggccacgcgcagacccgagcccggggcccccgcctctggctgccggcccgcgcccgccgcgcgccccgcgttcactgcgcgctcggccccggtcccgcctcccggagggtttcgctttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccatgttccttttacttatgtacatttttaataaaagaaagttgttaatgactca

SEQ ID NO: 119117 - DNA, 1080 bp, Homo sapiens
  Payload ID: 3344
  Gene Symbol: C5orf56
  Gene Name: chromosome 5 open reading frame 56
  ENST ID: ENST00000407797
  CDS Start-End: 124-237
gcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagccccgaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattatggaatttaggattgcaggacattctttgacatttcataacagccaggggagatcaactgtggtcaggggacaggggcaggaagaaaccatggccaaggcctgtctggcaggacttgaaggggcagagggacccttgcaaatgaccctgcctggaacccacccccagttggcccctgtatagcactgatccagctggggcttttatcccaggataccctcttcagggatgcctgtatttgttgattatctgccatatgcctggtcactgcagaatacaaggaagaaaatagccttcagcagaagctgagacaggagcctagaggatggacagtaaggagtcgaaggctcaggatgaggctttcctgactttctcccctagaggactgatgttctctactggtacagaccttgttttattcatccttatgtccctaacctggaatgggcccagggtgacagttataataagtgtttgtcaagtgagcaagtgtgtggagtgtgcattgtagagagtaaggtctctacaggatcctgctggagaggcagcccactgggctcaccacttctccagaggagggactggtcccttgccagacagccctgccagctggagcaggcttcctcaggggtgcctggagctgttgaccatggctgttgccctctggcccctcttgggaagagcaacctgtcaggtgttaaagacggtcttc

SEQ ID NO: 119118 - DNA, 486 bp, Homo sapiens
  Payload ID: 3344
  Gene Symbol: C5orf56
  Gene Name: chromosome 5 open reading frame 56
  Uniprot ID: Q8N8D9
  ENST ID: ENST00000621237
  CDS Start-End: 30-410
ctgaggatggccagcagagaaacaagaaaatggactccctggctgctggagagttgaatgccagccaccagccatgggtgccagagtttgtagcctattggaggaaaacacaccaagggaatcttcaaactcttcttctccactggctcctgctgtgctcctgtctccatcacctgtataatgcttcctgccatcctgccttccccgtggagtacagccatgctgtctgctgcttacagccaagattctggaaagaaatgtctcctttttcctcgtcatcaaccactcatttattcagcaagtgtttcttttacacttgcctgtgctgggcatggcagcaatgcagcagtgaacaaaaccatcagccctgctctcatgcagcttataatcaagtagagagacagacataaatgattaatagatgctcctgtaatggtggttgtgaggtgtgctgccacagcccagccacacacgccagttcccttc

SEQ ID NO: 119119 - DNA, 966 bp, Homo sapiens
  Payload ID: 3345
  Gene Symbol: C5orf63
  Gene Name: chromosome 5 open reading frame 63
  Uniprot ID: A6NC05
  ENST ID: ENST00000296662
  CDS Start-End: 152-499
ggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaata

SEQ ID NO: 119120 - DNA, 5680 bp, Homo sapiens
  Payload ID: 3345
  Gene Symbol: C5orf63
  Gene Name: chromosome 5 open reading frame 63
  Uniprot ID: A6NC05
  ENST ID: ENST00000535381
  CDS Start-End: 152-568
ggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattcttatttcagagaggaatatggtcatgtgactaggaatcctgcagatcttcagcaaacccatgggtcccaacagctggcaaaatgaaaggtagatacctacaaacatggcatctaaaaggtggtttgattatcccactgtcaagtatcagtgttatgtcacctattactgtgattttcatgtgatgtttgtagcagcaattacttttcctttctgaaattatgtttgcaaagatcaatttgtttttatataaagattaactttgatataagaagctcatcattcacctccaaaggaaaaggtgatacaagcttcctttttttcccccttcaagctaatgccttatgaaggagtggaatagtttgggacttcatattgctgctctagaatagtgcctctttcttccacatgtctcttcataacattatgagcttactggaacacatagctctttggccagtttattgcacgaaacaagggtatactcagactggggttttttaaataatgcagcaatctcatggacatctgacagtaggaatcacaatacagccaggcttcagaagtacaattaaagaaccacccaaaactgaaacatcacccttctcacagtgccttggcttattttcttccttgttctctcctggctcacagctcccctgcttacacacactatctgcttcctcatagctgcagcctgcttatgcccatcattactgctaacctttctgttcagcaatacagcaccctgagcctctcaggcttctctattctgaaatcctaaaaggaattttactcagcttatattttacaaccaggcacccatgacctaagttggctgaccaaatctatagaaggagccacctttaggacagaagcctatccctgggccaactggctatggaagcggtatgcaaatcacagtcactgcccactggcagaggccagaagcaggacaggcaatgaccagcaactctggcacgcctccaaaaagcttaagaatgtgacattctaccatactcaagagaagtcaggagggacacattggtaagttcacttatatcctactccataggagtaataaggacatgaaccaaagcaatgggagtcagacagaaagagatatcaggagatatttaggagtgaggttgacaaaacttcatgactgactggatgggtcggtagtgatgtggagaggggagtagagagaaagcatggattctgggataactcccagttttcttgcttacactactgggtgaattctgatactttttattccctgaggcagagaatgtaagaggaaggaaaagttagttttgggctgtgcttggtggatgggaaaggtaagacatggtgaattctccatgcttgtgggatatcaaggtaaagataaaagttagaagtgcaaaacaaaggtctggggttaaggtatacatttgagagcccactgagtatggttggaaatgtggccacctggcatataaggagaaaagcaagctattcccaaaccatggagaatactaatcttgacccatgagaatagaggaagttgctagtgaaggaaaatgagagagtggtggtggaactaggaatgggagaagctcatccaatttacattacgtgatgccttttgtgatttgatagtggcaggtattattccaagcactggggataaaacaacaaacaagatagccaggattcctactctcagagtcttgcattttaagggagagacagacaataaagatatcgtatcagaggaaaataatcatgaaagtcagggaggagcttttcccagagtaactgacagtatcaaatagcaagagagttaggatgaggactgaacagaagacatcagatttgaaaattagaaaatcagtgctgctataggaagaatagtccccaaagatacccaggtcctaattcctggaacctgtcacttatatgcataaaggactttgcagatttaagttaaggatcttgagatgggaaaattatattgcattatctaagcaggtcctaatgtaatcacaggtgtctctataagagggagtcagaaggagatttgactagggtaaagagagtaggaaattcgacaatggaagcaaaaggttggagtgatacaagaaagcagccatgagccaaggaatgtgaatggcctccagaagctaagaaaagaaaaagaaaacagattatcccctatagcctcccgaaggagcaagccctgctgacacgtttactttagttctgtgaaactgatttctgacttctggcctatagaactatgagagaataaatttgtgttgttttaagccaagtttgtgataatttggtacagcagcaatagaaaatgaatacaaatgtttccttgaccttattgagaacaacttttgtggagagggaagaggtaaactaaaagaaaattgtggtgggatgataactgaaagatacagaaaagacagcaaagtatccattttttaggaagtttttatatatctcatttgacccactaagaaacgacatccagaaaggagctaaagaccagaggtaattgattagctcagcacccaaaaatggcaggcagtgttggggcagtactagaatgaggtagccggccgggcacggtggctcatgcctgtaatgccagctctcagggaggcaagaggtgggagtatagcttgagcccaggagttcgagacctgcctgggcaatatagcaagaccccgttctccagaaaaaggaaaaaaaaaaaaaaaaaagcatagaatgaggtagccataacattctacctggcttttggctgaattgtggggaggagagttcagaggcctcaaaagtgaccctgacactggagagtaaaccatagtaacccattatagtccacagatatgcgcaccagacccatgactcttgttcaccatagagacaggatactttgatgctgtgacccaaaatcctgcacctggaacagatttggtacctctctattgacacagaaattcatgttgagcatggagacataatcaagagagaatggcctcattcgatcggtcttcagcttaggcactgacattttgcattttacctcctctctcaggttcaaagatgactaccaaagctaaacctctgaattctaaagtctacaaggacataaagcttcagggaaaggggaaatattaatattaatattaatgtcatacaaaagaggagaagcagcacataggagtgccagctaatagactagtagtaataagaagaatccaaccataggcctatattgagagtcatgggcatcccttctttatgctgaaatggtatatttgaacggaattcctgatggaaaactttctatccttagaaatactgtaggccaaatattaattggaacttttgttaatgatttgagaacaccaaaaagtttagatgatacaagttaaaggcaaattgagcccatggcctcattgtgctacttagaataccctgtgacccagctctcctcagaaaccctgatggctttgttgcagcattgcattgcacagaagacctcagtggtggtcctgagtcctcacaacaaggtcaacccgtggcctggccactaaggcaacagagagggaaataaattttagaaaacgcttcccttaaaaatgagttaaaatgtacatttgcatcatgagactaggttaactgtcacctgagaaagtcctatattcagaaagacttaatcctggaccaggtaaatgaggcatttgctgtatgttctttgttatgaatttaatgctacaaagagaaaatgggcattgatgcataatctgggtaaaaaagagatgtcagaagttgggaaagaactgccagaagagctatgttttaggatttcactccaccttaccctgtgttttcttgtaaagatattctcaaaattaggccaatttcactcttttaaggtcagaggagattaagatatttagaaatcagattgtgggattgattcccattgtgattgctgacttttagtatcagccttttgttctgcatggattctctcatcttgcaaactagcaagactcctgaatttggcaatgatcctgctctgtgaagcattctcaagttagggttcttatcaatgtcagatttcactaagccagtaataaaggaaaggttgagagagcaaaggatgtcactgagttgacacctaacagcacaaaacaacttgtcagctggcaggacaagccagcatgttcagggtggtcacagcctttgagttggaaagatagtcttttaaacattcttacctcaccaaataactttaatagataaaatttagttactccctcccacttttgttctattcatttaaagcagtgttttttaaaaatttatgtatatgtgactacatgaaaaatacattactgtgtttcttgatgttttatgacctgtacacaaagtgagaccagcagatgccttcaagagaaataaaggacactgctgtcattctaactaaattgtccagaggaggaaagaagagtacaaaaatgattatgaatacttaagaagaggcatgactttgtcattggtgtggagcctataattatgtgcaattccctacttaagactttttagttatgctgaacattgaaaaaaaactaaacagcggagaggagaaaagaaaaggggaaatttaaacatttaatggaacacattcattaaatggagacatcgcttcaccataagggggcagttaagggtttggtagtcctactcacttgctattgtcaaatcatttgttttatcatggatttgagatccttataagtcttcattattattttgaattcaagaatgattccttctgctcacaaaacatgatcacttttcattgatttttttttttaatattctgactggttttgcatatctggaaaagataaatcttcaaaatttggaaataaatatttttcctccctgccaaatcca

SEQ ID NO: 119121 - DNA, 2977 bp, Homo sapiens
  Payload ID: 3345
  Gene Symbol: C5orf63
  Gene Name: chromosome 5 open reading frame 63
  ENST ID: ENST00000508527
  CDS Start-End: 140-307
aagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggagtttctcagcacaaggtctctctttgcctgctgccatccatgtaagatgtgacttgctcctccttgccttccgccatcattatgaggcctccccagccatgtggaactgacccatgccccctttgtgatgaagccaaggaagtactcaagccttatgaaaacaggcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattcttatttcagagaggaatatggtcatgtgactaggaatcctgcagatcttcagcaaacccatgggtcccaacagctggcaaaatgaaaggtagatacctacaaacatggcatctaaaaggtggtttgattatcccactgtcaagtatcagtgttatgtcacctattactgtgattttcatgtgatgtttgtagcagcaattacttttcctttctgaaattatgtttgcaaagatcaatttgtttttatataaagattaactttgatataagaagctcatcattcacctccaaaggaaaaggtgatacaagcttcctttttttcccccttcaagctaatgccttatgaaggagtggaatagtttgggacttcatattgctgctctagaatagtgcctctttcttccacatgtctcttcataacattatgagcttactggaacacatagctctttggccagtttattgcacgaaacaagggtatactcagactggggttttttaaataatgcagcaatctcatggacatctgacagtaggaatcacaatacagccaggcttcagaagtacaattaaagaaccacccaaaactgaaacatcacccttctcacagtgccttggcttattttcttccttgttctctcctggctcacagctcccctgcttacacacactatctgcttcctcatagctgcagcctgcttatgcccatcattactgctaacctttctgttcagcaatacagcaccctgagcctctcaggcttctctattctgaaatcctaaaaggaattttactcagcttatattttacaaccaggcacccatgacctaagttggctgaccaaatctatagaaggagccacctttaggacagaagcctatccctgggccaactggctatggaagcggtatgcaaatcacagtcactgcccactggcagaggccagaagcaggacaggcaatgaccagcaactctggcacgcctccaaaaagcttaagaatgtgacattctaccatactcaagagaagtcaggagggacacattggtaagttcacttatatcctactccataggagtaataaggacatgaaccaaagcaatgggagtcagacagaaagagatatcaggagatatttaggagtgaggttgacaaaacttcatgactgactggatgggtcggtagtgatgtggagaggggagtagagagaaagcatggattctgggataactcccagttttcttgcttacactactgggtgaattctgatactttttattccctgaggcagagaatgtaagaggaaggaaaagttagttttgggctgtgcttggtggatgggaaaggtaagacatggtgaattctccatgcttgtgggatatcaaggtaaagataaaagttagaagtgcaaaacaaaggtctggggttaaggtatacatttgagagcccactgagtatggttggaaatgtggccacctggcatataaggagaaaagcaagctattcccaaaccatggagaatactaatcttgacccatgagaatagaggaagttgctagtgaaggaaaatgagagagtggtggtggaactaggaatgggagaagctcatccaatttacattacgtgatgccttttgtgatttgatagtggcaggtattattccaagcactggggataaaacaacaaacaagatagccaggattcctactctcagagtcttgcattttaagggagagacagacaataaagatatcgtatcagaggaaaataatcatgaaagtcagggaggagcttttcccagagtaactgacagtatcaaatagcaagagagttaggatgaggactgaacagaagacatcagatttgaaaattagaaaatcagtgctgctataggaagaatagtccccaaagatacccaggtcctaattcctggaacctgtcacttatatgcataaaggactttgcagatttaagttaaggatcttgagatgggaaaattatattgcattatctaagcaggtcctaatgtaatcacaggtgtctctataagagggagtcagaaggagatttgactagggtaaagagagtaggaaattcgacaatggaagcaaaaggttggagtgatacaagaaagcagccatgagccaaggaatgtgaatggcctccagaagct

SEQ ID NO: 119122 - DNA, 553 bp, Homo sapiens
  Payload ID: 3345
  Gene Symbol: C5orf63
  Gene Name: chromosome 5 open reading frame 63
  ENST ID: ENST00000509733
  CDS Start-End: 152-331
ggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacagggtaatataatacagtgtggcttttatgtatatggattgcatattagatgtggtataaagtatctgcctggatccttcctttaggaaaagagattaaatgatttttcttttaaattttctttctgttcttcagagagagagtttagtgcttattaccataaaactcattacacctaagtgttttcctctgagcagtactggttttcttactctggctcttactgagtcaaag

SEQ ID NO: 119123 - DNA, 333 bp, Homo sapiens
  Payload ID: 3345
  Gene Symbol: C5orf63
  Gene Name: chromosome 5 open reading frame 63
  ENST ID: ENST00000606042
  CDS Start-End: 1-174
aagacaactctgcctgtgttgaccttattcacaaaggacccatgccccctttgtgatgaagccaaggaagtactcaagccttatgaaaacaggtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatgg

SEQ ID NO: 119124 - DNA, 607 bp, Homo sapiens
  Payload ID: 3345
  Gene Symbol: C5orf63
  Gene Name: chromosome 5 open reading frame 63
  Uniprot ID: A6NC05
  ENST ID: ENST00000606937
  CDS Start-End: 48-464
gtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattctta

SEQ ID NO: 119125 - DNA, 478 bp, Homo sapiens
  Payload ID: 3345
  Gene Symbol: C5orf63
  Gene Name: chromosome 5 open reading frame 63
  ENST ID: ENST00000607731
  CDS Start-End: 127-396
ggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaata

SEQ ID NO: 119126 - DNA, 765 bp, Homo sapiens
  Payload ID: 3346
  Gene Symbol: C5orf67
  Gene Name: chromosome 5 open reading frame 67
  Uniprot ID: F2Z3F1
  ENST ID: ENST00000438651
  CDS Start-End: 227-610
caacagccaaatgaacaacttcacctgagcccttacctccaaggaagtgccacaggggaacccaaaggcccttaatcattaaaaaaaactttagagatgctggctgagccatcagtgagaacatggatgcatacacagaacctacatcttgtcatctctgctcttcgaggaatggagctggagaggcagagaagcaatgaagccgaattctgagtagtatactctgatgaagaggatattttacaagcatagaaaaaggagggctccagtcttcaaagaaccagagcatgggtaccaaagcctcccagagctagttctggtcccagctcagccacttgtctgtttgggtgactatagaactccagatccaggtgggctctttccatggagcctgagacttatgatgccaggtgcctggacaaagcttccaggtgatggtggcagtgtcccagagaagggaaagcatggcattctgggagcacagggccaggagcacccgggtttgaatgtcagctccccgttttccagcccttggacgtgttacctgtctggacatcagcctcagaataataatagccctgagcttcaggttaaggaaatcctcttatgagatagagctcagctcctcctgtagaagctgaaattccagacactggacttcccagtctcccttgccactagatatggacacgtgatcaagattccaccaatcagatggtctttgaatctgctagtgacaaaaagaaaggaacatgccaaatccat

SEQ ID NO: 119127 - DNA, 354 bp, Homo sapiens
  Payload ID: 3346
  Gene Symbol: C5orf67
  Gene Name: chromosome 5 open reading frame 67
  ENST ID: ENST00000611197
  CDS Start-End: 1-354
aggagggctccagtcttcaaagaaccagagcatgggtaccaaagcctcccagagctagttctggtcccagctcagccacttgtctgtttgggtgactatagaactccagatccaggtgggctctttccatggagcctgagacttatgatgccaggtgcctggacaaagcttccaggtgatggtggcagtgtcccagagaagggaaagcatggcattctgggagcacagggccaggagcacccgggtttgaatgtcagctccccgttttccagcccttggacgtgttacctgtctggacatcagcctcagaataataatagccctgagcttcaggttaaggaaatcctcttatga

SEQ ID NO: 119128 - DNA, 1093 bp, Homo sapiens
  Payload ID: 3347
  Gene Symbol: C6orf1
  Gene Name: chromosome 6 open reading frame 1
  ENST ID: ENST00000335352
  CDS Start-End: 555-974
tgatcacgcgcctgacggcttttccggggcccgggagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 119129 - DNA, 792 bp, Homo sapiens
  Payload ID: 3347
  Gene Symbol: C6orf1
  Gene Name: chromosome 6 open reading frame 1
  Uniprot ID: Q86T20
  ENST ID: ENST00000394990
  CDS Start-End: 194-673
cggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 119130 - DNA, 806 bp, Homo sapiens
  Payload ID: 3347
  Gene Symbol: C6orf1
  Gene Name: chromosome 6 open reading frame 1
  ENST ID: ENST00000413013
  CDS Start-End: 268-687
agccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 119131 - DNA, 1297 bp, Homo sapiens
  Payload ID: 3347
  Gene Symbol: C6orf1
  Gene Name: chromosome 6 open reading frame 1
  Uniprot ID: Q86T20
  ENST ID: ENST00000476320
  CDS Start-End: 684-1163
cacagacggaggccgagtgggcccggagcagggtcttgccgcgaagggcctgggctcaacgttagagcgtggcgcgaccctattctggctgcaacgagaggggtgaatgaagtgggcgccggggacctcccagaatcggagctccagacgcgggcgggccaggggccgccggaaaactgcgcgcgccccgccctaccccgtccggccccgcgtcgcgttctcctcccccactgcgcagccctcggctgccccctgccgccgccgggcggaccctgcaagccccgctgtccccgccttcgcaccgcccacccccgcctccggattggcggctccagaaatctccaggccaccggctttccgctaccggattggctgcgtccgggtgctgaggcccggcccatttccccgggtcctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggctaggggttttgatttca

SEQ ID NO: 119132 - DNA, 1053 bp, Homo sapiens
  Payload ID: 3347
  Gene Symbol: C6orf1
  Gene Name: chromosome 6 open reading frame 1
  Uniprot ID: Q86T20
  ENST ID: ENST00000481533
  CDS Start-End: 455-934
agcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 119133 - DNA, 903 bp, Homo sapiens
  Payload ID: 3347
  Gene Symbol: C6orf1
  Gene Name: chromosome 6 open reading frame 1
  Uniprot ID: Q86T20
  ENST ID: ENST00000468145
  CDS Start-End: 395-874
agcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatc

SEQ ID NO: 119134 - DNA, 2125 bp, Homo sapiens
  Payload ID: 3348
  Gene Symbol: C6orf10
  Gene Name: chromosome 6 open reading frame 10
  ENST ID: ENST00000375007
  CDS Start-End: 174-1859
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtggtaatttatgttttcagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 119135 - DNA, 2173 bp, Homo sapiens
  Payload ID: 3348
  Gene Symbol: C6orf10
  Gene Name: chromosome 6 open reading frame 10
  Uniprot ID: Q5SRN2
  ENST ID: ENST00000375015
  CDS Start-End: 202-1890
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119136 - DNA, 2148 bp, Homo sapiens
  Payload ID: 3348
  Gene Symbol: C6orf10
  Gene Name: chromosome 6 open reading frame 10
  Uniprot ID: Q5SRN2
  ENST ID: ENST00000383130
  CDS Start-End: 174-1865
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119137 - DNA, 2173 bp, Homo sapiens
  Payload ID: 3348
  Gene Symbol: C6orf10
  Gene Name: chromosome 6 open reading frame 10
  ENST ID: ENST00000383262
  CDS Start-End: 202-1890
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119138 - DNA, 2148 bp, Homo sapiens
  Payload ID: 3348
  Gene Symbol: C6orf10
  Gene Name: chromosome 6 open reading frame 10
  Uniprot ID: Q5SRN2
  ENST ID: ENST00000399749
  CDS Start-End: 174-1865
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119139 - DNA, 753 bp, Homo sapiens
  Payload ID: 3348
  Gene Symbol: C6orf10
  Gene Name: chromosome 6 open reading frame 10
  ENST ID: ENST00000425722
  CDS Start-End: 174-753
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaa

SEQ ID NO: 119140 - DNA, 2173 bp, Homo sapiens
  Payload ID: 3348
  Gene Symbol: C6orf10
  Gene Name: chromosome 6 open reading frame 10
  ENST ID: ENST00000424621
  CDS Start-End: 202-1890
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119141 - DNA, 778 bp, Homo sapiens
  Payload ID: 3348
  Gene Symbol: C6orf10
  Gene Name: chromosome 6 open reading frame 10
  ENST ID: ENST00000422186
  CDS Start-End: 202-778
tcccatcatttgcttaggtctgatcaatctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataa

SEQ ID NO: 119142 - DNA, 2148 bp, Homo sapiens
  Payload ID: 3348
  Gene Symbol: C6orf10
  Gene Name: chromosome 6 open reading frame 10
  ENST ID: ENST00000438312
  CDS Start-End: 174-1865
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119143 - DNA, 2148 bp, Homo sapiens
  Payload ID: 3348
  Gene Symbol: C6orf10
  Gene Name: chromosome 6 open reading frame 10
  ENST ID: ENST00000449847
  CDS Start-End: 174-1865
ctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctttcaagctctctcaaaaaaccattgtgcaaactctaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagcagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119144 - DNA, 2148 bp, Homo sapiens
  Payload ID: 3348
  Gene Symbol: C6orf10
  Gene Name: chromosome 6 open reading frame 10
  Uniprot ID: Q5SRN2
  ENST ID: ENST00000457429
  CDS Start-End: 174-1865
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagtaa

SEQ ID NO: 119145 - DNA, 753 bp, Homo sapiens
  Payload ID: 3348
  Gene Symbol: C6orf10
  Gene Name: chromosome 6 open reading frame 10
  ENST ID: ENST00000413045
  CDS Start-End: 174-753
ctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaa

SEQ ID NO: 119146 - DNA, 2173 bp, Homo sapiens
  Payload ID: 3348
  Gene Symbol: C6orf10
  Gene Name: chromosome 6 open reading frame 10
  Uniprot ID: Q5SRN2
  ENST ID: ENST00000448986
  CDS Start-End: 202-1890
tcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119147 - DNA, 1696 bp, Homo sapiens
  Payload ID: 3348
  Gene Symbol: C6orf10
  Gene Name: chromosome 6 open reading frame 10
  ENST ID: ENST00000442822
  CDS Start-End: 194-1600
tttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgagtgtttcaggaataaagacactcttatctatcatcatccagaagcttgagcacttgccaagaccgggaagtcaaacctgagatgccacactacagattatacacgttgtaagctaggtctcaataaattttctattcaaatcttt

SEQ ID NO: 119148 - DNA, 778 bp, Homo sapiens
  Payload ID: 3348
  Gene Symbol: C6orf10
  Gene Name: chromosome 6 open reading frame 10
  ENST ID: ENST00000423858
  CDS Start-End: 202-778
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataa

SEQ ID NO: 119149 - DNA, 2173 bp, Homo sapiens
  Payload ID: 3348
  Gene Symbol: C6orf10
  Gene Name: chromosome 6 open reading frame 10
  ENST ID: ENST00000451857
  CDS Start-End: 202-1890
tcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagtaa

SEQ ID NO: 119150 - DNA, 2148 bp, Homo sapiens
  Payload ID: 3348
  Gene Symbol: C6orf10
  Gene Name: chromosome 6 open reading frame 10
  Uniprot ID: Q5SRN2
  ENST ID: ENST00000447241
  CDS Start-End: 174-1865
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119151 - DNA, 2173 bp, Homo sapiens
  Payload ID: 3348
  Gene Symbol: C6orf10
  Gene Name: chromosome 6 open reading frame 10
  ENST ID: ENST00000427082
  CDS Start-End: 202-1890
tcccatcatttgcttaggtctgatcaatctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctttcaagctctctcaaaaaaccattgtgcaaactctaggacctattgtacaatatcctggatccaatgtcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagcagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119152 - DNA, 2170 bp, Homo sapiens
  Payload ID: 3348
  Gene Symbol: C6orf10
  Gene Name: chromosome 6 open reading frame 10
  Uniprot ID: Q5SRN2
  ENST ID: ENST00000533191
  CDS Start-End: 202-1887
tcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaa

SEQ ID NO: 119153 - DNA, 549 bp, Homo sapiens
  Payload ID: 3348
  Gene Symbol: C6orf10
  Gene Name: chromosome 6 open reading frame 10
  ENST ID: ENST00000534588
  CDS Start-End: 174-549
ctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattgctttacctcaaggatccatgatgcaat

SEQ ID NO: 119154 - DNA, 563 bp, Homo sapiens
  Payload ID: 3348
  Gene Symbol: C6orf10
  Gene Name: chromosome 6 open reading frame 10
  ENST ID: ENST00000532023
  CDS Start-End: 167-563
acacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagagatttttcttctcagagatctaaaagaggaagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccg

SEQ ID NO: 119155 - DNA, 2076 bp, Homo sapiens
  Payload ID: 3348
  Gene Symbol: C6orf10
  Gene Name: chromosome 6 open reading frame 10
  ENST ID: ENST00000527965
  CDS Start-End: 167-1810
acacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 119156 - DNA, 2173 bp, Homo sapiens
  Payload ID: 3348
  Gene Symbol: C6orf10
  Gene Name: chromosome 6 open reading frame 10
  Uniprot ID: Q5SRN2
  ENST ID: ENST00000548927
  CDS Start-End: 207-1892
cacactcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagt

SEQ ID NO: 119157 - DNA, 2125 bp, Homo sapiens
  Payload ID: 3348
  Gene Symbol: C6orf10
  Gene Name: chromosome 6 open reading frame 10
  ENST ID: ENST00000547550
  CDS Start-End: 174-1859
ctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtggtaatttatgttttcagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaatt

SEQ ID NO: 119158 - DNA, 1904 bp, Homo sapiens
  Payload ID: 3348
  Gene Symbol: C6orf10
  Gene Name: chromosome 6 open reading frame 10
  ENST ID: ENST00000548975
  CDS Start-End: 207-1904
cacactcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatatcacaaagtgacacttcatatgataaccgagcgcatatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcagccggagctacaggacctatcaagctctctcaaaaaaccattgtgcaaactccaggacctattgtacaattggatccaatgtcagatcgcatcctcacacaatcatacagtccaccttcagcaccccggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 119159 - DNA, 2131 bp, Homo sapiens
  Payload ID: 3348
  Gene Symbol: C6orf10
  Gene Name: chromosome 6 open reading frame 10
  ENST ID: ENST00000617503
  CDS Start-End: 207-1850
cacactcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagt

SEQ ID NO: 119160 - DNA, 1879 bp, Homo sapiens
  Payload ID: 3348
  Gene Symbol: C6orf10
  Gene Name: chromosome 6 open reading frame 10
  ENST ID: ENST00000620562
  CDS Start-End: 194-1879
tttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119161 - DNA, 1692 bp, Homo sapiens
  Payload ID: 3348
  Gene Symbol: C6orf10
  Gene Name: chromosome 6 open reading frame 10
  ENST ID: ENST00000620408
  CDS Start-End: 1-1692
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119162 - DNA, 1644 bp, Homo sapiens
  Payload ID: 3348
  Gene Symbol: C6orf10
  Gene Name: chromosome 6 open reading frame 10
  ENST ID: ENST00000613493
  CDS Start-End: 1-1644
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119163 - DNA, 1644 bp, Homo sapiens
  Payload ID: 3348
  Gene Symbol: C6orf10
  Gene Name: chromosome 6 open reading frame 10
  ENST ID: ENST00000614741
  CDS Start-End: 1-1644
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119164 - DNA, 2131 bp, Homo sapiens
  Payload ID: 3348
  Gene Symbol: C6orf10
  Gene Name: chromosome 6 open reading frame 10
  ENST ID: ENST00000612773
  CDS Start-End: 207-1850
cacactcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagt

SEQ ID NO: 119165 - DNA, 2179 bp, Homo sapiens
  Payload ID: 3348
  Gene Symbol: C6orf10
  Gene Name: chromosome 6 open reading frame 10
  Uniprot ID: Q5SRN2
  ENST ID: ENST00000612031
  CDS Start-End: 207-1898
cacactcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagt

SEQ ID NO: 119166 - DNA, 1891 bp, Homo sapiens
  Payload ID: 3348
  Gene Symbol: C6orf10
  Gene Name: chromosome 6 open reading frame 10
  ENST ID: ENST00000620772
  CDS Start-End: 194-1891
tttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatatcacaaagtgacacttcatgtgataaccgagcgcatatccaaaagagattacacaccatcaaccaactctctagcactgtctcgatcaagtattgctttacctcaaggatccatgagtagtataaaatgtttacaaacaactgaagaacttccttccagaactgcaggagccatgatgcaattcacagcccctattcagccggagctacaggacctatcaagctctctcaaaaaaccattgtgcaaactccaggacctattggctagagtacagcagcagtgcattgtggccattcacactgtgctggtccaccttcagcaccccggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 119167 - DNA, 1686 bp, Homo sapiens
  Payload ID: 3348
  Gene Symbol: C6orf10
  Gene Name: chromosome 6 open reading frame 10
  ENST ID: ENST00000621801
  CDS Start-End: 1-1686
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119168 - DNA, 1904 bp, Homo sapiens
  Payload ID: 3348
  Gene Symbol: C6orf10
  Gene Name: chromosome 6 open reading frame 10
  ENST ID: ENST00000617061
  CDS Start-End: 207-1904
cacactcccatcatttgcttaggtctgatcaatctgctccacacaatttctcagtgatcctctgcatctctgcctacaagggcctccctgacacccaagttcatattgctcagaaacagtgaacttgagtttttcgttttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatatcacaaagtgacacttcatatgataaccgagcgcatatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcagccggagctacaggacctatcaagctctctcaaaaaaccattgtgcaaactccaggacctattgtacaattggatccaatgtcagatcgcatcctcacacaatcatacagtccaccttcagcaccccggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 119169 - DNA, 1701 bp, Homo sapiens
  Payload ID: 3348
  Gene Symbol: C6orf10
  Gene Name: chromosome 6 open reading frame 10
  ENST ID: ENST00000615490
  CDS Start-End: 1-1701
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatatcacaaagtgacacttcatatgataaccgagcgcatatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcagccggagctacaggacctatcaagctctctcaaaaaaccattgtgcaaactgcaggatattggatataacacctgggtgacagatcagatcgcatcctcacacaatcatacagtccaccttcagcaccccggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtataccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 119170 - DNA, 1692 bp, Homo sapiens
  Payload ID: 3348
  Gene Symbol: C6orf10
  Gene Name: chromosome 6 open reading frame 10
  ENST ID: ENST00000614995
  CDS Start-End: 1-1692
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtgtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119171 - DNA, 1686 bp, Homo sapiens
  Payload ID: 3348
  Gene Symbol: C6orf10
  Gene Name: chromosome 6 open reading frame 10
  ENST ID: ENST00000620668
  CDS Start-End: 1-1686
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgctggtccaccttcagcaccccgcggtccacccatggcacccataataatttcacagagaaccgcaagtcagctggcagcacctataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaa

SEQ ID NO: 119172 - DNA, 1701 bp, Homo sapiens
  Payload ID: 3348
  Gene Symbol: C6orf10
  Gene Name: chromosome 6 open reading frame 10
  ENST ID: ENST00000621079
  CDS Start-End: 1-1701
atgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatatcacaaagtgacacttcatatgataaccgagcgcatatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcagccggagctacaggacctatcaagctctctcaaaaaaccattgtgcaaactgcaggatattggatataacacctgggtgacagatcagatcgcatcctcacacaatcatacagtccaccttcagcaccccggtccacccatggcacccataataatttcacagagaaccgcaagtcagctggcagcacctataagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgatgagtgtaccacaaggacagggagcccaaataaagaaaagtgtgtcagatgtaccaagaggacaggacaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaaggaggcaaatacaggaaggaagtacaacaaaaaagtggaagagtaaggataaattttttaaaggcccataa

SEQ ID NO: 119173 - DNA, 2179 bp, Homo sapiens
  Payload ID: 3348
  Gene Symbol: C6orf10
  Gene Name: chromosome 6 open reading frame 10
  Uniprot ID: Q5SRN2
  ENST ID: ENST00000618584
  CDS Start-End: 207-1898
cacactcccatcatttgcttaggtctgatcaatctgctccacacaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgatgtaagcaaagtgaaatgtatatctccagatacagttcagaacaaagtgctagacttctggactatgaggatggtagaggatcccgacatgcatattcaacacaaagtgacacttcatatgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacctccttccagaactgcaggagccatgatgcaattcacagcccctattcccggagctacaggacctatcaagctctctcaaaaaaccattgtgcaaactccaggacctattgtacaatatcctggatccaatgctggtccaccttcagcaccccgcggtccacccatggcacccataataatttcgcagagaactgcaagaatacctcaagttcacactatggacagttctggaaaaatcacactgactcctgtggttatattaacaggttacatggatgaagaacttgcaaaaaaatcttgttccaaaatccagattctaaaatgtggaggcactgcaaggtctcagaatagccgagaagaaaacaaggaagcactaaagaatgacatcatatttacgaattctgtagaatccttgaaatcagcacacataaaggagccagaaagagaaggaaaaggcactgatttagagaaagacaaaataggaatggaggtcaaggtagacagtgacgctggaataccaaaaagacaggaaacccaactaaaaatcagtgagatgagtataccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtcagtctggtgtctcaaagggacaggaagcccaggtaaagaagagggagtcagttgtactgaaaggacaggaagcccaggtagagaagagtgagttgaaggtaccaaaaggacaagaaggccaagtagagaagactgaggcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagt

SEQ ID NO: 119174 - DNA, 916 bp, Homo sapiens
  Payload ID: 3349
  Gene Symbol: C6orf106
  Gene Name: chromosome 6 open reading frame 106
  ENST ID: ENST00000374021
  CDS Start-End: 186-860
gtgtaacctctcctgtttttgtacatgtgtttattcctgaactgttttgggctactcattgttaaccaggttgctgctctacttttcccactgctggctaaggaagattcaactttttcaggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttgggggg

SEQ ID NO: 119175 - DNA, 4418 bp, Homo sapiens
  Payload ID: 3349
  Gene Symbol: C6orf106
  Gene Name: chromosome 6 open reading frame 106
  Uniprot ID: Q9H6K1
  ENST ID: ENST00000374023
  CDS Start-End: 245-1141
ggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 119176 - DNA, 4232 bp, Homo sapiens
  Payload ID: 3349
  Gene Symbol: C6orf106
  Gene Name: chromosome 6 open reading frame 106
  Uniprot ID: Q9H6K1
  ENST ID: ENST00000374026
  CDS Start-End: 257-955
ggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 119177 - DNA, 1812 bp, Homo sapiens
  Payload ID: 3350
  Gene Symbol: C6orf118
  Gene Name: chromosome 6 open reading frame 118
  Uniprot ID: Q5T5N4
  ENST ID: ENST00000230301
  CDS Start-End: 22-1431
gcagctggagggaaggaagcgatggcggaggagcgggagcctgaattgtacctgaagtggaagcactgcgagacgccaggcgtgaagaccctgtgtaatctgaagcactgcgagacgccaggagtgaagaccctgtgtaatctgaagaaacttctgaatcggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggccctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaatttgcacgtgcagcccccagcagttcaacagactgcacgtctttggaaaagtctttgaagatatttgtaacagttctttgatatttggtgatctcttgaaaaaagttaaggatgaatatgaactctacatggcaacgctcctggagtcccagcctgcagcacagtacgaggctcttctggctcaactcaaggcgctggggcagaggccggtgaagacggcggacatggatctcgccagggaagagctgaggatgctcgtgacagccacaaaagcagccctggagcagaatgatagactcagaagtgaactggagatggaggtggcattgctgcagtctgcaaaggaacgatcagaatcatctgagaaacatataattgatgaaaaccgacttactcttactgagaaggttgaaaagaagaggtgtgaaatactcagtaagtgggatgagatacaagctctggaaaaagaaattaaaacaactttggttcatactggaatttcagatatcactgagaataggattaaaagcatagagcatgaagctatacaattggaaacagaaaatatgattttaaagaagaaaataaaagggcctttggaaatttatcaaggaatttgtaaaatcagaggaaacagaagataacgctcaagtggctgaacaaatggccagtggaaattcttaacttccatgtatgtagcatggatatttgcagatgcatatacattcataaagatacatttcatttcatcagctttaatctctagtaaaattaatgtggtatatgtatcctactcaggatactgaaatacacacatgcgtacacatgattagtttctgttgcatacatatttacaacaatactagttcttaacgtatgttttactttcatttaataatgttcaactttggaaaatacttttgattatttgctaagaataaggaattcagcgctgcttgaatacagctcaaatttgtttatttgccaacacaagtttacatatatgcatttaataaaattttata

SEQ ID NO: 119178 - DNA, 2667 bp, Homo sapiens
  Payload ID: 3351
  Gene Symbol: C6orf120
  Gene Name: chromosome 6 open reading frame 120
  Uniprot ID: Q7Z4R8
  ENST ID: ENST00000332290
  CDS Start-End: 271-846
agtggtggtgagtccgagggtgccacagcggccctgcccctgcccctgcccctgccctgagtgggcgccgcgctacgggggaggggttaacccacccctcctccccggggcctcacgcgggtgggaagggacagtcccagcgacagaccaggcgcctggacgcgccgtggacccgcgtgcggacggcggggacaggctccggtgctgagcgcctccggtgtccccagcagcactgacccacttgcaggccccggagctgagccgccagccatggccgctccccgcgggagggccgcgccctggacgacggccctgctgctgctcctagcctcgcaggtcctgtctccgggaagctgcgcggacgaggaggaggtccccgaggagtgggtgctcctgcacgtcgtccagggccagataggcgccgggaactacagctacctgcggctgaaccacgagggcaagatagtcctcaggatgcgcagcctcaagggagatgcggatctgtacgtctccgccagcagcctgcaccccagcttcgacgactacgagctgcaatcggccacctgcggcccggacgccgtgtccatccccgcgcacttccggcgcccagtgggcatcggcgtctatggacacccctcccacctggagagcgagttcgagatgaaggtgtactacgacggcacggtcgagcagcacccgttcggcgaggccgcctaccccgccgacggcgcagatgccggccagaagcacgctggtgccccggaagacgcctcgcaagaggaggaatctgttctctggacgatattaattagcattttgaaactggtacttgaaattctcttttgagtcgttgaccacactctgggatataaaaccctccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcacaaagtgtttagactccattttcattaggcaggttgactaaaaatgattgcagtaacaggtttatataaaatagagcaacctttcatgctgtgacacaaatcaaaaggttgataactttgtaattttactctggagattctaaccgaagttggtgtaagttttcaagagttactaaaatcaagttggaaatgatttacgtacacttccctgagcctggactaaagcctcatgcctgtaccccaagtaggtgatggtacttttctatacaaaaaggatttcctggcaggcaggtatttacaaagtttgttcctgtaccagtccaataatgacaactctaaatccagctgcaccaaatcttagtgggccatttgtcatacctatgaaaattcttcagttattaaataactttgtcagtgctacctatggtaggccggaaacaatgtagattaggaagtttcatgaaaattaacttttggggctatggagaaacagttaagtatcttaagttactaaacatttccactgaatttttggagtgagccaaggttactataaaatactttggaagatgaattctctacctggagttagtttcgagagtaagcgtagcttttaacagaaataactgcagattttaagctcataatttgcaaaaaaaatcttttattggcatgaaaataatgttgtaaatggcaccaaatattccacttaaatgcatatacagtattagagtcaaaaactattttatccctctttgctgtttttcccccttctgcccactttcctgggtgttgggggggcccgctgacaacagtcacaaatccagcgacctaggaaaaaaattgttaatatagaatgaaaaattatctttacaggactgaattttaagcccatctaaactcttctgccttagctatcactaatgatattcctctctggattttgtggtgagaagggcactatgagttccttaatttaaggaaaaaatgtaaacttaatcaatgtaatcaatgccatgcaaaattcattgcaagtcaagggggatgggagagatgcaatgccatacggtgatacggacctttaagaaagtacaatctttcctgaaattcaaacactatcatacttcaaaaggtcaaaacccattccggaatttggcttttttaagactttttctctcctgctcactggcagctgtgtgtcttaacagcattctttcaagtcctggtgtactctgctgacagcactttaaaactttaacagcacaatgataacttgtactacatacttgatctgaattactacagaaaaataattatgttgcttgcttaatgattcccaggaaacttcgttgtaggcatatattttataagagtattatacagtgttaactatgcaagtaagttctaaaattacacaattatctgtgtaatgttttagtccaattactgtgatttattcaactctgttctaaagttatctggaattgtcatgctgcctcaatttacagaaatctataatagatttctatagaaatgtataaagacgtagcagtcattttgttgtttctaaatagataacatataaaaataaaggctttg

SEQ ID NO: 119179 - DNA, 6210 bp, Homo sapiens
  Payload ID: 3352
  Gene Symbol: C6orf132
  Gene Name: chromosome 6 open reading frame 132
  Uniprot ID: Q5T0Z8
  ENST ID: ENST00000341865
  CDS Start-End: 1-3567
atgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgaatgcccaggaaaaccatgggctggctgtgcccaccccctcggttccagatgattttgcagacaaagaagtgacaggtaccagctcactagtcaatggcaacctccgactgtacagctctgtgggtgacctgaggcctggacaatatggccaggatctactcatccccccacctcccccaggcccagccccagggccccctcaggacatttcagaacctccaggggggtcgccactgccatctccaccttccacagcacccccaccacctcccctgctgctggaacccccacccccgcccagcatggccccacctccacccccagtattggaggccctatccccaccacacactctttcctccccatccatacccacccctcctgacttcattccccctgccccacccttggcctttctagcccccccaccgcctcctgtgccagccccagcacccccagctccagcatctcctcacacagtggggactcgtctctttccccctgggggtgtcaccaagtggaaatcagatgtagcactgaatggcaggcaggcagaggccaccagagccagccccccgagaagccctgctgagccaaaggggagcgccctgggacctaacccagagccccatctcaccttcccccgttctttcaaagtgcctcccccaaccccagtcaggacttcgtccatcccagttcaggaagcacaagaggctccccgaaaggaagagggggccaccaagaaggctcccagccgactcccactgcctcccagcttccacatccgccccgcctcccaggtctacccagacagggcccccgagccagactgccctggggagctcaaggccacagcaccagccagcccaaggcttggccagtcccagtcccaagcagatgaacgagctgggactccgcctccagcccctcccctgccccctcctgcaccccccctccctcccccagcacccccacttcccccagctgcacctcctttgccctgtgctcagaaggcagcccatccacctgctgggtttacaaaaacccctaaatccagctctcctgctctcaaacccaaacccaacccccccagcccagagaacacagcgtcttcagcacctgtggactggagggaccccagccagatggaaaagctgcggaacgagctggcagcctatctctgtggctccaggagagaggaccgattcctcagtcacaggccaggcccaacagtggcccctcagagcaaggagggcaagaagggcccccgcctgcctgagaaggagactctcctgagcctgccagcaaaggacactcccccaggtgttcctgaaaagagtcttggcggcagcagcctgacagagacagaggctgcccccagcctgaccctgccctctgtggactacattccccaagactctccaactcccagtgtgcggcagatccggaatgagctggaggcccggctctcctcagcagcagagaaggaggctaagcccagcataggatctctgccccctaagcctcggctagaagggggaagaatttgtgaaaacggggctgatgatgacaaactctccaagcctgtggccaagaatctgccacctcaatccaccaccctgctgccaactacatcactccagcccaaggctatgttgggaccagccataccacccaaggccacacctgagccagccataccacccaaggctacactttggccagccacaccacccaaggccacacttgggccagccacaccactcaaggccacatctgggccaaccacaccactcaaggccacatctggccctgccatagcatctacagccacaactctgcccaccaccacatcccaactgatggcagagaaggactcaggcccagctggccagccagagaagccagcatctcaagaagtttccactccctcccaggcaaggggagaggggtccccctcagaggccactaggctgcccacacagggagcccgctcatctgcagccttcccaccaaagacatctcctggtggaggagaggtgccatgtctctacaagccccactgccaccagagcagcctcagccgtgaggttgctgtggtgatgcccaccctggccagaggaggggctgcagggccaggggagcccgtggaggtgaaggagcccccagggctgccagccaagcctcctgcctcggcccagcccactgatgaactcctcaggcacccggtgactggggaggtggtggagcggggctcgccgatggccctgctcctggcggccaggcagagggctcagaagggaaggtctgtaggggctgccctgggtcggtcctctctgccaggaagtctccgtgaccacagccaccaagccgaggccagctctgacagcatcttccacagccagggcacgcccaactccttcactgtggtgcccaagttacccaaggaggctgagaaggactccccgctgacgaccgaaatacccaataagtgggggccgcggctgggaagagacgcagagggcacagagctgagccgcaggcacaactggacaaagccagagccccaggcccctgtggcctgggaaagagtagctccctccaacctcccccagggccacccgctgcccaagtccttctcctccccaccttctccttcgaacaagagggaggaggaggaggaggagttcaacttcgaggtcatcccaccgccgccagagttcagcaatgaccctgagcccccggccccggccctccagtatctgggccgccagagctcccctccccggaacaactactcagacttgaggcagctcccgaacgctggccccggggcgcccccggctctcggcttctcgcgctttcccgcgggcgcgcgctacgccggggctgggggcctggagcgcttctcgggagggggccgctcgctcataaagaagcgcctgtacgtcggggagccgcaccgaggcccagggctaccccacggtggcaccggccgcagcctgagctctcccaactgcttcgggccgcagcccggaggccccgagatgcggcgcgtgaactcggcgggtcgcgcgccccccggaggcctgcacgcgccgaggctgtccctggagggcgccgcccggggcgccgcggaggccaagcacaaagcgcccggcagcgccgactacggcttcgccccagctgccggcaggtctccctacaccaccacccgctatggaagccccatcaacacgttcaccgtgaggcctgggacccgccatcccatctcctatgtctgctcaggggcccatcggaaagccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagcccttagctacagggaggcctagagagaggacacttggcaagtttaggatgggaaacaaggttaagcctggctttgctattcagacctgtgcagccctgattttggggactgggcccaaggagccatgagtcttaggcttgacactaggggccttacatggccaggtctcatatgggatttggagaaggcatttttcctaacactgatactacaagtcaccaatactcttgatgccttaagatgctagaaagccttggagagtggaggcagcagagatgggaatggaggtctgaagaagcttgctgctgttggggaatgtgtttgggaaagtcaagagtggtaggattggttggctgggcgcggtggctcacacctgtaatcccagcactttgggaggccgaggccggtggatcacttgaggtcagaagttcgagaccagcctgcccaaatggtgaaaccccatctctactaaaaatacggaaaaaaaaaaaaaaagagtgctaggattgggccagttaagagcaggggagacctggctgggcatggtggctcacacctgtaattctagcactttgggaggctgaggcgggtggatcatgaggtcaagagattaagaccatcctggcctacatggcgaaaccctgtctctactaaaaataaaaaaatgacctgggcatggtggtgggcgcctgtagtcccagctactcggggcgctgaggcaggagaatcgctcgaacccaggaggtggaggttgcagtgagccgagattgcacaattgcactccagcctggcgacagagcgagactcgtctcaaaaaaaaaaaaaaaaaaaaaaaaaggagcaggggagacctatcagtagggtgaccacgtgtcctttgcctgggcagtccaggtttatgcttgttttccagtgaattagacccccttccacttttcaaaaaagtcctggtttagatgctgtgatcaccaaacatatcaggaaacaatattccttggtcttgcttccctatcttcaggtactggtgggccaaattcctgggaccaggtcaaggtgggctgcctcagtaagaaggaaggactggagagtgcccatttcagaggagcaggctggtgggggccagccagaaagtagttccctttggggggaagatgttggacctttattatttgtggtaaccagccgaggctggttgtcaggacagcaggtgagccactttagggaagaaagtgcaggggtgggtggatgcccagattaccaaggccagccaccctgatggggtagggtctggttatctgtgttcaagaagcaaatcccaccccagccccagcactagctctctatgtatgtattttccctgtacaatgttttataaaagagatcattaatttatctgctatgttaaggctcgaggggtggggcgtagactctcagctgtatattgctctggggtgggcagggaaggctgagtctcacttgacttggaagataaacaggccagtttggactggcctccagctccgtggctgtgtttgtctaacaaggatttgggtaactactggatacaagccactgtgcttagtatggatagactgccatcagctcacccacatgactcctgttcatggcaagctaatagtctgtctggtggaagaggattgaaaaagcacacaaaaacatcataaattacaaggagtagtaagaaggaaaaaacagggaacgtgagagaataactagcgagtggggagaggagtggatttactttaacagggtagtcagggaaggcctcttgtggtggtgacatactgatttaggcaaagcgtccagcacgtgcctagcgcttagtagttgctcagcaaatggcatctttgggtgatgaatacctcacatttgtatatggcctgtcacagttttccataaagcttttttttttaaggccat

SEQ ID NO: 119180 - DNA, 894 bp, Homo sapiens
  Payload ID: 3352
  Gene Symbol: C6orf132
  Gene Name: chromosome 6 open reading frame 132
  Uniprot ID: Q5T0Z8
  ENST ID: ENST00000356542
  CDS Start-End: 176-475
tttcccggcaagcggcggcgcccgcagcacctgttgcccggtgcgcgggcggggaggacggcgggggacatggcctggtagagtcccctggggagaccgtgctgagttcagtccggggcagggcagggcgagggagggaaggtccttccctggcgcccgcgcgggctgcggcagcatgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgactgagtttcattcttgttgcccaggctggagtggtacaatggcgtgatctcggctccctgcaacctccacctcctgggttcaagcgattctcctgcctcagcctcccaagtagctgggattacaggtgcccaccaccatgcccggcaaattttttgtatttttagtagagacagggtttcaccattttggccaggctggtctcgaactcctgacctcaggtgatccacaaacctcagcctcccaaagtgctgggattacaggcgtgagctaccgcgcccagcctgaaatactctatattgggaggttaattagattctctcctatcacttaccctcagcacacatacccagattcatagcagtgtgggcccagagttgacacacctctaccagtcggtaaaatactaaaacattcatctgtaaaatgggaataaaaaaaaaaaaacaaataaaatactgaaataca

SEQ ID NO: 119181 - DNA, 1978 bp, Homo sapiens
  Payload ID: 3353
  Gene Symbol: C6orf136
  Gene Name: chromosome 6 open reading frame 136
  Uniprot ID: Q5SQH8
  ENST ID: ENST00000293604
  CDS Start-End: 194-1684
cttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagg

SEQ ID NO: 119182 - DNA, 614 bp, Homo sapiens
  Payload ID: 3353
  Gene Symbol: C6orf136
  Gene Name: chromosome 6 open reading frame 136
  Uniprot ID: Q5SQH8
  ENST ID: ENST00000376471
  CDS Start-End: 69-614
gcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctga

SEQ ID NO: 119183 - DNA, 1402 bp, Homo sapiens
  Payload ID: 3353
  Gene Symbol: C6orf136
  Gene Name: chromosome 6 open reading frame 136
  Uniprot ID: Q5SQH8
  ENST ID: ENST00000376473
  CDS Start-End: 160-1107
gcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagga

SEQ ID NO: 119184 - DNA, 808 bp, Homo sapiens
  Payload ID: 3353
  Gene Symbol: C6orf136
  Gene Name: chromosome 6 open reading frame 136
  Uniprot ID: Q5SQH8
  ENST ID: ENST00000383580
  CDS Start-End: 69-614
gcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119185 - DNA, 1301 bp, Homo sapiens
  Payload ID: 3353
  Gene Symbol: C6orf136
  Gene Name: chromosome 6 open reading frame 136
  Uniprot ID: Q5SQH8
  ENST ID: ENST00000383581
  CDS Start-End: 160-1107
gcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119186 - DNA, 808 bp, Homo sapiens; identical to SEQ ID NO: 119184
  Payload ID: 3353
  Gene Symbol: C6orf136
  Gene Name: chromosome 6 open reading frame 136
  Uniprot ID: Q5SQH8
  ENST ID: ENST00000456444
  CDS Start-End: 69-614

SEQ ID NO: 119187 - DNA, 1496 bp, Homo sapiens
  Payload ID: 3353
  Gene Symbol: C6orf136
  Gene Name: chromosome 6 open reading frame 136
  ENST ID: ENST00000447330
  CDS Start-End: 1-1302
cttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119188 - DNA, 1301 bp, Homo sapiens; identical to SEQ ID NO: 119185
  Payload ID: 3353
  Gene Symbol: C6orf136
  Gene Name: chromosome 6 open reading frame 136
  Uniprot ID: Q5SQH8
  ENST ID: ENST00000422530
  CDS Start-End: 160-1107

SEQ ID NO: 119189 - DNA, 808 bp, Homo sapiens; identical to SEQ ID NO: 119184
  Payload ID: 3353
  Gene Symbol: C6orf136
  Gene Name: chromosome 6 open reading frame 136
  Uniprot ID: Q5SQH8
  ENST ID: ENST00000455682
  CDS Start-End: 69-614

SEQ ID NO: 119190 - DNA, 1496 bp, Homo sapiens; identical to SEQ ID NO: 119187
  Payload ID: 3353
  Gene Symbol: C6orf136
  Gene Name: chromosome 6 open reading frame 136
  ENST ID: ENST00000424031
  CDS Start-End: 1-1302

SEQ ID NO: 119191 - DNA, 808 bp, Homo sapiens; identical to SEQ ID NO: 119184
  Payload ID: 3353
  Gene Symbol: C6orf136
  Gene Name: chromosome 6 open reading frame 136
  Uniprot ID: Q5SQH8
  ENST ID: ENST00000417649
  CDS Start-End: 69-614

SEQ ID NO: 119192 - DNA, 1301 bp, Homo sapiens; identical to SEQ ID NO: 119185
  Payload ID: 3353
  Gene Symbol: C6orf136
  Gene Name: chromosome 6 open reading frame 136
  Uniprot ID: Q5SQH8
  ENST ID: ENST00000430141
  CDS Start-End: 160-1107

SEQ ID NO: 119193 - DNA, 1301 bp, Homo sapiens; identical to SEQ ID NO: 119185
  Payload ID: 3353
  Gene Symbol: C6orf136
  Gene Name: chromosome 6 open reading frame 136
  Uniprot ID: Q5SQH8
  ENST ID: ENST00000419321
  CDS Start-End: 160-1107

SEQ ID NO: 119194 - DNA, 808 bp, Homo sapiens; identical to SEQ ID NO: 119184
  Payload ID: 3353
  Gene Symbol: C6orf136
  Gene Name: chromosome 6 open reading frame 136
  Uniprot ID: Q5SQH8
  ENST ID: ENST00000415931
  CDS Start-End: 69-614

SEQ ID NO: 119195 - DNA, 1496 bp, Homo sapiens
  Payload ID: 3353
  Gene Symbol: C6orf136
  Gene Name: chromosome 6 open reading frame 136
  ENST ID: ENST00000449122
  CDS Start-End: 1-1302
cttcccacctgtgccctgcagcgcgtggacaggctaggggtcgcggaagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119196 - DNA, 1496 bp, Homo sapiens; identical to SEQ ID NO: 119187
  Payload ID: 3353
  Gene Symbol: C6orf136
  Gene Name: chromosome 6 open reading frame 136
  ENST ID: ENST00000442792
  CDS Start-End: 1-1302

SEQ ID NO: 119197 - DNA, 1301 bp, Homo sapiens; identical to SEQ ID NO: 119185
  Payload ID: 3353
  Gene Symbol: C6orf136
  Gene Name: chromosome 6 open reading frame 136
  Uniprot ID: Q5SQH8
  ENST ID: ENST00000425581
  CDS Start-End: 160-1107

SEQ ID NO: 119198 - DNA, 808 bp, Homo sapiens; identical to SEQ ID NO: 119184
  Payload ID: 3353
  Gene Symbol: C6orf136
  Gene Name: chromosome 6 open reading frame 136
  Uniprot ID: Q5SQH8
  ENST ID: ENST00000417076
  CDS Start-End: 69-614

SEQ ID NO: 119199 - DNA, 1496 bp, Homo sapiens; identical to SEQ ID NO: 119187
  Payload ID: 3353
  Gene Symbol: C6orf136
  Gene Name: chromosome 6 open reading frame 136
  ENST ID: ENST00000453871
  CDS Start-End: 1-1302

SEQ ID NO: 119200 - DNA, 1496 bp, Homo sapiens; identical to SEQ ID NO: 119187
  Payload ID: 3353
  Gene Symbol: C6orf136
  Gene Name: chromosome 6 open reading frame 136
  ENST ID: ENST00000411654
  CDS Start-End: 1-1302

SEQ ID NO: 119201 - DNA, 1496 bp, Homo sapiens; identical to SEQ ID NO: 119187
  Payload ID: 3353
  Gene Symbol: C6orf136
  Gene Name: chromosome 6 open reading frame 136
  ENST ID: ENST00000446773
  CDS Start-End: 1-1302

SEQ ID NO: 119202 - DNA, 1301 bp, Homo sapiens; identical to SEQ ID NO: 119185
  Payload ID: 3353
  Gene Symbol: C6orf136
  Gene Name: chromosome 6 open reading frame 136
  Uniprot ID: Q5SQH8
  ENST ID: ENST00000447505
  CDS Start-End: 160-1107

SEQ ID NO: 119203 - DNA, 692 bp, Homo sapiens
  Payload ID: 3353
  Gene Symbol: C6orf136
  Gene Name: chromosome 6 open reading frame 136
  ENST ID: ENST00000465699
  CDS Start-End: 1-315
atcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119204 - DNA, 445 bp, Homo sapiens
  Payload ID: 3353
  Gene Symbol: C6orf136
  Gene Name: chromosome 6 open reading frame 136
  ENST ID: ENST00000463794
  CDS Start-End: 107-283
ccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctaga

SEQ ID NO: 119205 - DNA, 613 bp, Homo sapiens
  Payload ID: 3353
  Gene Symbol: C6orf136
  Gene Name: chromosome 6 open reading frame 136
  ENST ID: ENST00000484551
  CDS Start-End: 194-466
cttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagggccggacatggtacattctttcactgaccctctgccgtttcctggcct

SEQ ID NO: 119206 - DNA, 464 bp, Homo sapiens
  Payload ID: 3353
  Gene Symbol: C6orf136
  Gene Name: chromosome 6 open reading frame 136
  ENST ID: ENST00000487873
  CDS Start-End: 1-147
gatcctagtatggaggaacatctgtctgtcatgtatgagagactgagacaagagcttcccaagctcttccttcagtcccacgactacagtctgtattccttggatgtggaattcatcaatgagatcctcaacatacgtaccaagtgagaattggggcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctaggtagggctgggtggggtaaag

SEQ ID NO: 119207 - DNA, 492 bp, Homo sapiens
  Payload ID: 3353
  Gene Symbol: C6orf136
  Gene Name: chromosome 6 open reading frame 136
  ENST ID: ENST00000468785
  CDS Start-End: 1-87
caagcccggtggcggcttgtggggctgcccgtccacttgctctttttgcggttctacaagcgtgacaaagacgagcattaccgctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaagga

SEQ ID NO: 119208 - DNA, 583 bp, Homo sapiens
  Payload ID: 3353
  Gene Symbol: C6orf136
  Gene Name: chromosome 6 open reading frame 136
  ENST ID: ENST00000467801
  CDS Start-End: 1-286
gggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaagtgagtcctagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatga

SEQ ID NO: 119209 - DNA, 1337 bp, Homo sapiens
  Payload ID: 3353
  Gene Symbol: C6orf136
  Gene Name: chromosome 6 open reading frame 136
  ENST ID: ENST00000488383
  CDS Start-End: 178-744
cgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagagcttcccaagctcttccttcagtcccacgactacagtctgtattccttggatgtggaattcatcaatgagatcctcaacatacgtaccaagtgagaattggggcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaa

SEQ ID NO: 119210 - DNA, 1820 bp, Homo sapiens
  Payload ID: 3354
  Gene Symbol: C6orf141
  Gene Name: chromosome 6 open reading frame 141
  Uniprot ID: Q5SZD1
  ENST ID: ENST00000371194
  CDS Start-End: 119-853
agctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactttggcctggttgaagctctgtgaggagcaaagcagccctctccaggtgaactgcttgactttaccacctgaaggagtatttactgcaagaattaacaaagcagactgcagtgcaacggcacgatcttggctcaccacaacctctacctccagggttcaagcgatgctcctacctcagcctcctcagtagctgggattacaggcatgtgccatcaccccggctaattctgtatttttagtagagatggggtttctccatgttggccaggctggtcttgaactcccaacctcaggtgatcctcctgcctccgcctcccaaagtgctgggattacaggtgttcctgatccaagcagaaccctgttatttgaagagcctgagaaatcttatcccgtttacaaatgtcctgggagtgcatccaaagtgaaacttgggcatcctcaatactaagaaatctctgagaatgactggatcttggctctttgatcttacctctactcctctgaaaaacatgattatctaaaattgtgttaggtggatgaaccgcatcaaagacttccagaagccactccagtgaccataagataaatgtcagaatcgcataacccccaggatcagagatggagtctcactctgtcacccagcctggaatgtagtggcatcattgtaactcactgcagcctgaaactccttggcttaagtgatcctcccacctcagcctcccaagtagctggaactataggcacaagctaccatgcctggctattcttttttgttaattttttttaaactaaggaatgaagaaaataaaacattacatga

SEQ ID NO: 119211 - DNA, 585 bp, Homo sapiens
  Payload ID: 3354
  Gene Symbol: C6orf141
  Gene Name: chromosome 6 open reading frame 141
  ENST ID: ENST00000415078
  CDS Start-End: 1-218
agacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaaggag

SEQ ID NO: 119212 - DNA, 1450 bp, Homo sapiens
  Payload ID: 3354
  Gene Symbol: C6orf141
  Gene Name: chromosome 6 open reading frame 141
  Uniprot ID: Q5SZD1
  ENST ID: ENST00000529246
  CDS Start-End: 148-882
gcggttagcctggggctgatctagtcttcagctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtaagcagcataatacctcctttgtggcttgaattccttcgctgtctggggacctaagtcattcagaagaggtggagaaaagatattttcagattggcagaatgtgggagttttgaaatgagaaaacctgttgttaatttgcattttggaataactctcaattgatctcttttctgttccccgcccccctcttgtttctctttaggacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaa

SEQ ID NO: 119213 - DNA, 1692 bp, Homo sapiens
  Payload ID: 3354
  Gene Symbol: C6orf141
  Gene Name: chromosome 6 open reading frame 141
  Uniprot ID: Q5SZD1
  ENST ID: ENST00000414696
  CDS Start-End: 128-862
ctagtcttcagctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtgttcctgatccaagcagaaccctgttatttgaagagcctgagaaatcttatcccgtttacaaatgtcctgggagtgcatccaaagtgaaacttgggcatcctcaatactaagaaatctctgagaatgactggatcttggctctttgatcttacctctactcctctgaaaaacatgattatctaaaattgtgttaggtggatgaaccgcatcaaagacttccagaagccactccagtgaccataagataaatgtcagaatcgcataacccccaggatcagcctgttgctcaggctggagtgcaatggcacgatctgagctcactgcaaccacctgcctcccgggttcaagctattctcctgcctcagcctcctgagtagctgggattacaggcgcctgcaaccacacccagctaatttttgtacttttagtagagatggggttttgccatgttggccaggctggtctcgaactcttgacctcaggtgatctgcctgcctcagcctcccaaagtgctgggattacaggcttgagccaccgagcctggcctctactttttattactgtcatgtagttagtgataaaatgcttctatctgaaaaaaaatttgttgttctaaattctaaaaaattctcgtgattattgcttaaattttaataaagcagatgtgattttcaaatta

SEQ ID NO: 119214 - DNA, 1140 bp, Homo sapiens
  Payload ID: 3355
  Gene Symbol: C6orf15
  Gene Name: chromosome 6 open reading frame 15
  Uniprot ID: Q6UXA7
  ENST ID: ENST00000259870
  CDS Start-End: 5-982
caggatgcagggccgcgtggcagggagctgcgctcctctgggcctgctcctggtctgtcttcatctcccaggcctctttgcccggagcatcggtgttgtggaggagaaagtttcccaaaacttggggaccaacttgcctcagctcggacaaccttcctccactggcccctctaactctgaacatccgcagcccgctctggaccctaggtctaatgacttggcaagggttcctctgaagctcagcgtgcctgcatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccaaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagtcctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgtcagcatgtttccagcactatccccacttttcagtgcctcccctgctcatctccaataaaataaaagcacttatggaa

SEQ ID NO: 119215 - DNA, 1140 bp, Homo sapiens
  Payload ID: 3355
  Gene Symbol: C6orf15
  Gene Name: chromosome 6 open reading frame 15
  Uniprot ID: Q6UXA7
  ENST ID: ENST00000383532
  CDS Start-End: 5-982
caggatgcagggccgcgtggcagggagctgcgctcctctgggcctgctcctggtctgtcttcatctcccaggcctctttgcccggagcatcggtgttgtggaggagaaagtttcccaaaacttcgggaccgacttgcctcagctcggacaaccttcctccactggcccctctaactctgaacatccgcagcccgctctggaccctaggtctaatgacttggcaagggttcctctgaagctcagcgtgcctccatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatggaa

SEQ ID NO: 119216 - DNA, 1140 bp, Homo sapiens; identical to SEQ ID NO: 119214
  Payload ID: 3355
  Gene Symbol: C6orf15
  Gene Name: chromosome 6 open reading frame 15
  Uniprot ID: Q6UXA7
  ENST ID: ENST00000440933
  CDS Start-End: 5-982

SEQ ID NO: 119217 - DNA, 1140 bp, Homo sapiens; identical to SEQ ID NO: 119214
  Payload ID: 3355
  Gene Symbol: C6orf15
  Gene Name: chromosome 6 open reading frame 15
  Uniprot ID: Q6UXA7
  ENST ID: ENST00000412706
  CDS Start-End: 5-982

SEQ ID NO: 119218 - DNA, 1140 bp, Homo sapiens; identical to SEQ ID NO: 119214
  Payload ID: 3355
  Gene Symbol: C6orf15
  Gene Name: chromosome 6 open reading frame 15
  Uniprot ID: Q6UXA7
  ENST ID: ENST00000427005
  CDS Start-End: 5-982

SEQ ID NO: 119219 - DNA, 1140 bp, Homo sapiens
  Payload ID: 3355
  Gene Symbol: C6orf15
  Gene Name: chromosome 6 open reading frame 15
  Uniprot ID: Q6UXA7
  ENST ID: ENST00000452899
  CDS Start-End: 5-982
caggatgcagggccgcgtggcagggagctgcgctcctctgggcctgctcctggtctgtcttcatctcccaggcctctttgcccggagcatcggtgttgtggaggagaaagtttcccaaaacttcgggaccaacttgcctcagctcggacaaccttcctccactggcccctctaactctgaacatccgcagcccgctctggaccctaggtctaatgacttggcaagggttcctctgaagctcagcgtgcctccatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacctgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatggaa

SEQ ID NO: 119220 - DNA, 1308 bp, Homo sapiens
  Payload ID: 3356
  Gene Symbol: C6orf163
  Gene Name: chromosome 6 open reading frame 163
  Uniprot ID: Q5TEZ5
  ENST ID: ENST00000388923
  CDS Start-End: 252-1241
aactacttaaatcttcccaaatctggtgcccataccttctatggcaggggcttttagcaccattctttaacgttagacacataaccacagcctaatcacttgaaccatttaatccttaccagcctctagcattatcctaaaaccctgaacctcttccagctttcttaaactttcagcttttcttgaaacgactttttctgattctaagattattttaactgtaagtaggagaagacatctgaaatttaactatgatcagaaattcagattacaaaaactttgtttgctgtgctgtttgtaataaaataattccaccagccccttttggaaaaaccttcaaacggatccatgaatacaagccacttaagacacgcttttacactcacaaagacatactagatattggggcaaatattctgaaaaaagaagagcagtttcaagaagatatactcagagaacacattgcgaaagcagaagctgaagtatgggctcaggctaatgaacgtcaaaaacaagcagtggagaaagcacttgaagaagcaaatgacagacacaaaattgaaattcagattttgaaagaggaacatcagaaagatttacaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacca

SEQ ID NO: 119221 - DNA, 2110 bp, Homo sapiens
  Payload ID: 3356
  Gene Symbol: C6orf163
  Gene Name: chromosome 6 open reading frame 163
  ENST ID: ENST00000608326
  CDS Start-End: 1445-2044
tatttctacacaatgttgggcttttgcagtatgtgtccatctccaccgtaatatatgctgccctgtgtttttaagattcgctgatgaactagtaggagactctgtgccgccaaacatatacttttaattgctagtgacagaaacataactcagaatagactgcatgaaatggaatttcttgactcttttaacagagaaacccaagggaaatctggcatcaaggctttcaatctgtccatgcttacccttttagtgagttggcttaatggtttactgctgcagctagacttactccggcagctgggaaaggaggaatgtggatccagatagctctaagaatctattaccttcagcttagaaatcccagaggaagaccaggcatggtggctcacgcctgtaatcctagcactttgggaggccgaagtgggcagatcacttgaggtcaagagttcgagaccagcctgaccaacatggtgaaagcccgtttctactaaaaatacaaaaattagtcaggcatggtggtgggcgcctgtaattccagctactcgggaggctgaggcaggagaatcacttgaaacgggaggcggaggttgcagtgagccgaaatggcgacactgcactgcaggctgggctacaaagcaagactccctctcaaaaaaaaagagaaatcccagtggaaaaagacctggctgtctgatattgcgtggtcctctagcctctctagacttttattaccttgtctgggtagagaggatattattatgggaatgttattatttggaaatcaaattagatcattgacagaaaaatagtaaacttctaccccttagctcactccatactgaagcagttaaacccacaaagaaccacatgctaaagaaaggcatgtaatgtgaaggcattccacttcccttctcctgatgctagccctagcacccaaataggaacagggagagagagagctgtataatgtgctaagacctcttgaatattcactcatcattctactttgggtgtacaaaatatgtccctttcttcgggcatttatttcacctccccagttgtctgctgtgtggactgggtgtgatgaggggaatgaccaactctatccaggcctgacagtgctgtgaattccctcctaatcagagaaaatcttactctttcaatgggtatctttgaaatatatatactggcatctcctaaaaggacgtgtctcctaaatagccctcataaataactagataatggtggaaaggaaagccaggaagcagtcggtggaggtttgtgaccattgctcttcaaatacacagatattggggcaaatattctgaaaaaagaagagcagtttcaagaagatatactcagagaacacattgcgaaagcagaagctgaagtatgggctcaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacc

SEQ ID NO: 119222 - DNA, 1956 bp, Homo sapiens
  Payload ID: 3357
  Gene Symbol: C6orf183
  Gene Name: chromosome 6 open reading frame 183
  ENST ID: ENST00000417143
  CDS Start-End: 82-1956
tgtaagagttgctgtagcaacctcacagctgtgctctgtctagcagaaacttgggatacagaaaaacagcaaatacaaatcatggatgaaatttataagatcacttccacagaaagggtccagctgttggagaaaaaactggctgtgcaactgactgaactgaagtctgagatagaagagcagggagctcttcagggaacagctaatcgagtttacagctctattcaaatgccaaaggatatttattactttagaagagagagggaactagcactgaagaaaaccttacaggtggccgagtcgaagccccttgttgttcaggcagatgccgtgcagagggagctagagagctgcctaagaagggagtacacccctgaaaatttacctttgcttctgttgcagtattacacagagagaattgcccagctggcccagagtaaatatttacacatgcttaggtggaagaggttttgccaacacagtaagatcatggagcaactttatcctctttacaagaaacaagttggctacattatgcaggagtacaatgacacccttcagagagctgaaagattgtctgttgctcgagaaaacttcctcatgggaaaaaacaatcctcctaacttggtgacacaggaagatctgactatttacacaaagtggttagtgtgccacctgcactctcttgggactgttcaccagtacctgcaggccctccagtatttgcccatctccaaagtgctgagtgtagctttcaaccgagtcgctgaagctggtcagaaaaatgaaaatgtctgtgtcaatgacattgaccctgacattcagggttctgcatctcctgaccctgtggataccagcatttctgggccaatgagaacagaagctgcttttgtcctcccccaacatgcaacagaaacaggagaactgaaacctcagctgaagctcctgctctcccatttcagtatcccatatgacgtagaagagctctgggactctgctaaggaaatggaacttttttccttggtttcccaaaaatttcaaagcgtcttcatggagcaacagagattgcaaatgtttccagactgtgaagctggaatagctaaagcagataatttgggtttggcaggacccagaatgaccctgaaaaagaaagccaactggatttccttcataaagatcaagccaaaatgtgatccatggcaaaagaagcttttgactaaattaaaagaacggagaagaacagatgcattattgcaactccaagcaaagtttttgaagatttccaaccctgagtgagtaatgcaagtgctccaagatcacgctgcaaagacagtcatgctggctccacatcagccatcgtttgtggcttcccaaggtttgcatcagggcaattatgaccaagtctgggagaatattgacaacaacatcaacctctgtcagaataaaaatatgaaagatgatgacctctccatgaaacaaaatgaaaatgatctatcacagataactctcagccaacatgctgatgggcctctcaagcagatacaagagacagggtacaactatgcaatgaccctacaactgctgggcttggaagacggcactgaccccagtgataggaatcctgttctgatgagaggggcctacttgtcctttctgtatctgtgccaccttcgaatcagagaactgcagcacatctgcttaggaattctgaattatttcagatctgttgagcgaaccctgacaatcaatacttcgggccttaccttggtttcagggaaactggtccccaccatggaagatagttcctgggtaaatatggcaaaaggaggtctgggcaccttgcagggcctgggcgctcaccactatgtccgtgagacacctgctgagcacaaggtccacagcgtccaattcatggagttctcggaagtggagaaccaggatgactactacagcaca

SEQ ID NO: 119223 - DNA, 2496 bp, Homo sapiens
  Payload ID: 3358
  Gene Symbol: C6orf201
  Gene Name: chromosome 6 open reading frame 201
  ENST ID: ENST00000436110
  CDS Start-End: 204-551
atcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagtaatactattccttccattttgctcccttgctacatggctgaaaaagaacatgcaacccactgaagacctcaagtcagtgatctgtaggctgtcagcatttggcccaattcagtcagccactgtttgtggacgtcaaagtgctatagtggcattcaaagacatgacttcagcctgtaatgctgtgagtgcttttcaaagtaggaccccaggcaccatgttccagtgttcctggcaacaacgattcatgtcaaaagacaaaacttattcaaaaaaatgtacccagaagacacagcctaaggaatacaagcaggaaactgagaaacctgccaacaacagctaaagggacacaaacagtgtctcctgaatctttcagaataacatgaaagctgtatacctattgtggaatttgattagaatccggaacagtcagagttggaacaatgttcacaacaaaatgcaagttaataatgaaggaaaaataaaatcagtcaaatcagcctaatgctttgggaaaaatctaaattcagttaattctaccacaaacaacatgtaacctgcttatgactggcaacgctgaaggaggattcaaaggctctcatctcgcgctgcttgcctgacctcttgctttctaggagctgacttaccctgtcagatgcatacacggcatcgaatagcccaaggagggtgacggagatgcccacagctggaccattgaccactgcaatcagaggcttaggaaaatctataaaacagcccacaaattccctacagaaatggaaacacaaaatcattaaatgtgccaaagcagcatgactaaagcatgggcaagacagtctgactctgagataaagccttctgtcaggctgggtgtttccacagccaccaccagcagtgcctccttgtcctgccacttccctggtcttccgcaccagattcatccagggcatccgtctgaatggcagtggatggaagaccaaccagtgagacctatgggtcaaccctggtttgaatcttgtattctggacagtgagttcagggctgtaaaccagccgcagtcttagagattaggttgggtgactgagcacatgctgcaatatcacaacaagtgggaattacagatttggcaggaataaagagaaaagccttcatgacctcctcctgtgtttacaagactcctccgagtctcctaccttcagcgttcatggaaatctcccattcctctggctggatgagaatttgctaaattcctctgcctcagtgcaagataattttgtttacaactatagctcacttttatgttttccagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagt

SEQ ID NO: 119224 - DNA, 2403 bp, Homo sapiens
  Payload ID: 3358
  Gene Symbol: C6orf201
  Gene Name: chromosome 6 open reading frame 201
  Uniprot ID: Q7Z4U5
  ENST ID: ENST00000427996
  CDS Start-End: 371-766
gggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagaataacatgaaagctgtatacctattgtggaatttgattagaatccggaacagtcagagttggaacaatgttcacaacaaaatgcaagttaataatgaaggaaaaataaaatcagtcaaatcagcctaatgctttgggaaaaatctaaattcagttaattctaccacaaacaacatgtaacctgcttatgactggcaacgctgaaggaggattcaaaggctctcatctcgcgctgcttgcctgacctcttgctttctaggagctgacttaccctgtcagatgcatacacggcatcgaatagcccaaggagggtgacggagatgcccacagctggaccattgaccactgcaatcagaggcttaggaaaatctataaaacagcccacaaattccctacagaaatggaaacacaaaatcattaaatgtgccaaagcagcatgactaaagcatgggcaagacagtctgactctgagataaagccttctgtcaggctgggtgtttccacagccaccaccagcagtgcctccttgtcctgccacttccctggtcttccgcaccagattcatccagggcatccgtctgaatggcagtggatggaagaccaaccagtgagacctatgggtcaaccctggtttgaatcttgtattctggacagtgagttcagggctgtaaaccagccgcagtcttagagattaggttgggtgactgagcacatgctgcaatatcacaacaagtgggaattacagatttggcaggaataaagagaaaagccttcatgacctcctcctgtgtttacaagactcctccgagtctcctaccttcagcgttcatggaaatctcccattcctctggctggatgagaatttgctaaattcctctgcctcagtgcaagataattttgtttacaactatagctcacttttatgttttccagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaactca

SEQ ID NO: 119225 - DNA, 1834 bp, Homo sapiens
  Payload ID: 3358
  Gene Symbol: C6orf201
  Gene Name: chromosome 6 open reading frame 201
  Uniprot ID: Q7Z4U5
  ENST ID: ENST00000380175
  CDS Start-End: 766-1188
gtattcgcgggccgcggggtcgccgccggccgcccaggcgcggagcctctcgggggtcacccggccgccgggcccgcgggacgcacggggccgccaggggaggacaacaagcctcaggccctgtccctgcgccccgcccggcctcccccgcggggctgcgcagcccactcggccatcctggcctgaaggggccgcccccggcctcgcgggaaagcctgagcctcccgggccttctcgggccttctcggactttcccccaggcgtcctggaccttcttcggccttcctgggcctcctcgggcttccttgaccctccccaggccttccccgaggcctccaggcccttccctgggcctctccaggctgagctctccgcgacatggccagtgggcctctgggacccggggcccggcccacccgcctccaccctccattcccaccgcctgctcacatcaagccaggagcaccgcccggatgaacacgcagggttccggaccaatacctgggccattgtgactctcagaatgccaggcaataagagatcagaaagctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaataggaatgatgctgaaactctacagcttttgtgtgaaacacatagaagaagaaagtaaaacaggacaaactccgtgggcaggctccacctgactagaggattccaatgaaggactcaaactggacaccaaatccacatagttctgcctggcagcttcctgaacggacgatgacaaacaacctcagcccatggtcaatgaataagcactttgagaaagttactatactaataactaacaccttgcaatgaagaaagaatagaagcacatcaagatcttgaagactccatttacaatggcttaatgagaagcacaaacttctttagaagtacagcaaataaaagcacagtaactagtaaactcaccttgggcaggctgccaagggcattccatgcgtcccatttggccttgttgatcaagtcaaatacacctggtttgggcatgttacaaggtccttcagtggcctgtgaaaaggagaggggcaatatgttcaaatgtccatgtaaactagacccctaaatatttaagatccataaaatctgtaagtaca

SEQ ID NO: 119226 - DNA, 949 bp, Homo sapiens
  Payload ID: 3358
  Gene Symbol: C6orf201
  Gene Name: chromosome 6 open reading frame 201
  ENST ID: ENST00000451679
  CDS Start-End: 219-635
agctggttccacttcatcttggagatggaggaaagcttgccagaacaactgcacaccccatccactcctcatgttctcagtttgttcttctctgtgatacaaccagcatcacgagaacagccagcagcagctccagcgtgataaaattttcactccttgacaagtgtaagaagccggaaaactgtgcccagccagaagttttgtgtcgcccctttgagatgctgtctaacctccacgagctgcttccgaatcacctgatggagacgctttattcccgcaagagtgaagaggacaagaaaaaatgtgagaatcctgaactctctggcttagaaagaatcttagcaagacatcagttgccaaaagagattaatctgaccccaaagccgaacagaatgcccccgtggaaaagaaaaatcatcaacaatgtaactgacgggtggaagaaatgtcacttgttgaagagaaacacgaaagagcctccaatgtccaccatagttgtcagaaaacttattcaaaaaaatgtacccagaagacacagcctaaggaatacaagcaggaaactgagaaacctgccaacaacagctaaagggacacaaacagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggaaaatcacagtgccttctgggtatatcagaacctacctgaaattcacaaactctaaacaatgaatgctcaactctgttgtatgaagtagccacaattaccaaccttcctgcacaaatcaaacaagagatatcttaaaata

SEQ ID NO: 119227 - DNA, 900 bp, Homo sapiens
  Payload ID: 3359
  Gene Symbol: C6orf203
  Gene Name: chromosome 6 open reading frame 203
  Uniprot ID: Q9P0P8
  ENST ID: ENST00000311381
  CDS Start-End: 72-794
agcctggaggcctgcagtccgcgcggccgcggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtggaa

SEQ ID NO: 119228 - DNA, 1420 bp, Homo sapiens
  Payload ID: 3359
  Gene Symbol: C6orf203
  Gene Name: chromosome 6 open reading frame 203
  Uniprot ID: Q9P0P8
  ENST ID: ENST00000405204
  CDS Start-End: 598-1320
agcctggaggcctgcagtccgcgcggccgcggggagggacgagagggcctgacgtacaggtgagtgcgcctctgctggcgcgccgcgccgggccccctgcccgcgccccctgtcacttcgcctctccgccccgcccacgctcccgccgggtctccccgtgagtgtcccgtgtcctgccagcctcgggacgccccgcgagctcagggctgcgcagggactgtggtaattgagcgcggcgaagccttccgttcctgcctcctgtcgctcctgctggctccgaatgcagactgcgaacccggggacgcagttgtccatttcctttgaccttggggacccaggaaggtgcactgcccgcgggggtggggagggagcgagaggaatccgaccctgtctcagcccacagcctccgaggtctccaagtaaagggaaggatctttagctgcattagacttcaaagcgtttagaccagtttctccatcttacggagcggtgaacgggctcaggaatgtggagcgtttcctggcgtcaagcaggtcaaagtcagcgctgctttttttacagacactgcttttcttacagtcttcgattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgttt

SEQ ID NO: 119229 - DNA, 1146 bp, Homo sapiens
  Payload ID: 3359
  Gene Symbol: C6orf203
  Gene Name: chromosome 6 open reading frame 203
  ENST ID: ENST00000625458
  CDS Start-End: 310-1047
ggggtggggagggagcgagaggaatccgaccctgtctcagcccacagcctccgaggtctccaagtaaagggaaggatctttagctgcattagacttcaaagcgtttagaccagtttctccatcttacggagcggtgaacgggctcaggaatgtggagcgtttcctggcgtcaagcaggtcaaagtcagcgctgctttttttacagacactgcttttcttacagtcttcgactataaactctacaagaataggaatcttcgtatttttttcctctgctgaattcctagtgcccagattagtgcttggcacatgattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtt

SEQ ID NO: 119230 - DNA, 3736 bp, Homo sapiens
  Payload ID: 3360
  Gene Symbol: C6orf222
  Gene Name: chromosome 6 open reading frame 222
  Uniprot ID: P0C671
  ENST ID: ENST00000437635
  CDS Start-End: 179-2137
actcagaaaattgccagcaccaaagtagtggcatcttctccctgggagagctgggtctgacttctcactggacacaacttccagctgacagggagcagagcctaacacagagacctcttgtctgaagatcccagcccagggtgttcaggacagaagcgatttctgtggtccaagcccgatggagaatccaaggtgcccaaggaggcccctggcggagaagaaagccaggtctctggacaggccgcaggcccccgggaaaggctcggagtcgtgggactgccattggctctccctgcccactgccccctccaggaaggcgcttcactggacgaccagtgattgggccagacattcagacagcccagctccatctgcagaggctcactgcaccaccgctgcagcccccactcccgaggagaccggagattttctccccagcgagcagaggccttcgcaagacaccaagaaggggtggctgaagaccatgctgaacttcttcgtgaggacgggccctgaggagcccagagaaaaggccagcaggaggccaagggggaaggagggtatctcccagcatccggagcccctggaagcagcaggggagccagccctcaggaagaaagcccaccacgacaagaagcccagccgcaagaagcaaggtcacaagaaacacgcggccgaggtgactaaggcagctcaagaccaggaggccagaggccgagaggaagggttgtccaaggcagctgctgccttgcgctccggggaggctgacctgggcccagctcgcaggggtggggaagattctgatcaccagtccttcctcatcaaagtggatggtactggagctttggatgtttctccccatgccacaggtcatcagcaagaagaggagctcaaaaagcctgaccaggatgctatcattcagatgatagtggaattgctcaaaagagtgggagaccagtgggaagaagagcaatctctggcctcacagctgggggtggccctgccaaacccagcaccagctgttaggaagaaatcccaagagaaaaagacaagcctcaagagaacctcaaagacaaaccccaagaaacacggctccgaggaggccaagaggggggctgcagatgtttccagtccagaggcctggccacccaagaagtccagctttctgcccctgtgtgtcagcggccatcggccttccatctccagcagctatggcttggaagaacctaaagtccaggaggccccatctacagaggctggggctccaggtccctccgtgcttcccaccccatcagagagccaggaacctggagaggagcttccgctggacagagcctcggaatacaaagaattcattcagaagatcatttccatgctccaagatgcagaagaacagcaaggagaggagcaacctcaagtccagcaggaagaggtgggtgtagaaaacccggccccacactgcagaaggaaatctcaagaaaaaaggtcgagcttcaggagagcgttttaccataagaaacacacctccaaggaacccagaagagcgggggcagcaggggctgccagcccagaggcccgacgacccaagaggcccagctttctgcccctgtgtgttggtggccatcggccctccacctccagcagccttgatccagaagatctcgagtgccgggagcccctgcccgcagaaggggagccagttgtgatctcagaagcaccctcccaggctagaggccacacgccagaaggggcacctcagctgagtggagcatgtgaatctaaggagatcatcatccagaagcttgtggcacttctccaagaagtggatggccaactggggcagcagatcaggcgccaccccagctttaagaggtttttttacgagttctcggactcctccctcagcaagctggtagccaccctgcgcagccaggtggctcactcctctaagctggacaggaaccgcgccaggagactctaccagtttgacgttagcttagctaacaaatttgctggcagcaacagccatgccatgtgcatcctcatgggcctaagagaccactacaattgcacccagttcccatacagggaggaccagccgaacatcacaagtcctaaggttgaaagtccagattgaaagctgtgtcttgcactcaaattcccttgaactagccaaatggttcgcagctttagccaggagaccctgaagatgctctgtgatgtcccaatccctgcttcacaaacgtgatggaagacaagagcagacaatcattctgtgtccataccctagtatctgagaagcacagagcattcttccacaaggcaagacacagaggccatgtctggggaaatcagcactggactgggaatgaggaagactggggctctacctgctgaacctaccccagacttgctgcatgaccctctacacattccccctcctctccagactttggagtctaggatcccacccagaaggcctactgatattttctcagatgttcatgttaactgagtctagtttttaaactaaatttttatttaatctctaaacagaacatccacatgcatccaaacagatatgcatcgaagtgtatcccatcatttcttcagttgaccagtagttcttcatgctcatatggatttgtagatgcctcccaggaactctgcaggcccaagatggaaaaacctagagactggggacacttggtctctcagaatccttctaaccctgtgtcctgtcattctatgactagagaaatggagctgataccttgcacctctcccatctcatgggattggctaggagtcagtgagaaaatggatgtgaagagttctgaaaattacctagtgccatgtccatgtaggcactatagcttcttttgggtagttttcaggaagtggaggagggcttcaatgggctggactgccatggattgttgcacaggggtgcactgctcaagagcaccatactccaggaggtactattcatgtcctagacattgtggatttgtagatttatcatgacagttttgcagctggtagcagtaacatgtcttgagaaaagggctattttttgtatttgcacaaaggtgaagtgtgggggtgccagaggctctgccttctgtatagctcaacagtttcaatagcttgactcaggtgtgaaatttgccacatgttcatatctatgtgcaggaaggacaagactgtagacagacagtcggctcccttggacactgcccagaacatgtggtcatgggggaaagggtgttaaacctggatggcaagtgagatcttgtgacccttggggacatggtattgccgtgttgaacctgctgtcgcaccatggggtaggactggggaggaggagcagtctagagcggagaggccctgggtgcttatatgggactggcctccaacctgaggcactggcttcataagctcaactcagcctatccggaaagccatttagtttttattgctgcttctgagaagtgggggagaggtgagctatttgtggatttgttttaggcagtgttcacaatcatagcacctaaatatgaaggatcagaataagttatgaaatgaaggtcaggaaccttttgtacatagtttcttatttggaatgatgttctttaagccctatgagtatttggtatgtgctcctgatgctggcatctgagtctcatttttgtaccgtgttatttgagcaaataaatacattaacttgcacaaa

SEQ ID NO: 119231 - DNA, 2757 bp, Homo sapiens
  Payload ID: 3361
  Gene Symbol: C6orf223
  Gene Name: chromosome 6 open reading frame 223
  Uniprot ID: Q8N319
  ENST ID: ENST00000439969
  CDS Start-End: 4-321
gtgatgatgccactggcagaagcaggcgccctggcccaaggaggaggcccttcagcaacggagtgggcctgcattctgcggaggttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacacca

SEQ ID NO: 119232 - DNA, 3581 bp, Homo sapiens
  Payload ID: 3361
  Gene Symbol: C6orf223
  Gene Name: chromosome 6 open reading frame 223
  Uniprot ID: Q8N319
  ENST ID: ENST00000336600
  CDS Start-End: 21-749
ggcggctgaggagtggggtgatgatgccactggcagaagcaggcgccctggcccaaggaggaggcccttcagcaacggagtgggcctgcattctgcggaggaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacaccatttgtcacgctttgatgaatgaaacttactaagaataactcagtccttgtagactctaaaggacagggggagggagagggaggaggctggtgattgtgggggtgctgggggagggaggacacaatccatttattcaatagcatttcctgagtccccagctgggcactgggggagacacagtgagtgccacagagccccctactgtgccatttctgccactgactgccagggcagactctgagacagaaagttcaggttcctgcttcagagcctccccaccccagcagtcattacctcagggccacccagccccctccatgccagtcatgagctccctctgcccctcccttcagtggaggggagactttgaaatcaggtgcttggggggggggcgctgctcccagtgggggtgtgaggaacctggaggatgaatccctgtcccccgccctccccctactctattcttccttaccctgcccctttccactccaaaacctcaagcctctggttcacatctgagtgacctttccaaagcaactgttctcagggggtccttgggagccgggaggctgtgaccttaacccacttctttggacagtgccttcctggcactccacccccacctgccacctcctgagaggaacatttcggctggtcttggcaaaaacatcagtctatgatccaggcagcctggtacagtaccagctctgccactgacaccactgtgaccttgggaagccatttacacatatgggtctcagtttctccatatgtaaaatgacttttgtttagctttcctgattttcaaacctttttttcaaacagtgaatcctcttgtttaaattgtaaa

SEQ ID NO: 119233 - DNA, 3109 bp, Homo sapiens
  Payload ID: 3361
  Gene Symbol: C6orf223
  Gene Name: chromosome 6 open reading frame 223
  ENST ID: ENST00000442114
  CDS Start-End: 417-1085
taattgccaacctgatgactggcggctgaggagtggggtgatgatgccactggcagaagcaggcgccctggcccaaggaggaggcccttcagcaacggagtgggcctgcattctgcggagggtgagactgaggtggctgcagtcaaaggagaagggggcaggggtttgttgaggctgtgaccgtgggaaagcgcttctccagggcttccctcagcttcaaggagaaagagttcagaggccctgaggggatgaagggacttgtgaaggggcttcagggggatgggttggggggaaggaggttcctattcttactccccttctgcctatgctcccccaatgttcctgtctctcccctcccccaccttggccccctctttggcccctgtggccaaagttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcagtccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattgctgcccctttgtggtctgcatgtttcttggtaagggtgcccagtcaagtgtctctgggagccccctcttctctgtcatcgtcaggctccccacttgcagtggccgtggtggctgcacatgctcccggatacccctccagcactcccttttgtcatcttgagtttcagtccgtgacttgggtggcaccctatcttctccatcagggatggtagctatttttctgccatgagactagaggttgcttgagaacaggaaattggatctctcccttcaggctgggatttcactaagggctggagaaggggggaatatgggaggattatctcctatcacagggagcgctctgagggcaaggctgtgtctccgattcagactgacggttccctgaggatggggctgtttctcccctccgactggggctccctgaggatggggctgtttctcccctccgactggggctccctgaggacagggctgtgtctcccctcagcctggggctccctgagtcagggctgtgtctcccctcagactggggctccctgaggacggggctgtgtctgcctcagactgggaatccctgaagatggggccgtgtctccctcaaagtggggctccctcaggacagcgttgtgtctcccctcagactgcggctccctgaggacggggctgtgtctccctcagactggggctccctgaagaaagggctgcttctccctcagactggagctccctgaagatggggctgtgtccccctcagactggggctgcctgaggatgaggctgcatctcccctcagactggagctccctgagggcagggctgtctccccccttcagactggggcctcccccaaaggacagggactgtgtctcccctgggactaggttctttgtgtcttctgcatcagacagattcccatgaggacagggctgtctccccctccatctggagctccctgaaggcaatggcctctcccctcaaatgggacatttgcaccccaccccaccctctggctccccatggcgcccaggcattcctcccaggacaccatttgtcacgctttgatgaatgaaacttactaagaataactca

SEQ ID NO: 119234 - DNA, 552 bp, Homo sapiens
  Payload ID: 3362
  Gene Symbol: C6orf226
  Gene Name: chromosome 6 open reading frame 226
  Uniprot ID: Q5I0X4
  ENST ID: ENST00000408925
  CDS Start-End: 29-334
acacgccggtcaggattcgcgacccgacatggagcgtccccgcagtccccaatgctcggccccggcctctgcctcagcttcggttaccctggcgcagctcctgcagctggtccagcagggccaggaactcccgggcctggagaaacgccacatcgcggcgatccacggcgaacccacagcgtcccggctgccgcggaggcccaagccctgggaggccgcggctttggctgagtcccttccccctccgaccctcaggataggaacggccccggcggagcctggcttggttgaggcagcgactgcgccttcttcatggcatacagtgggcccctgaggttccaggtcctttgcggcggcgatctggagggcgtggctacaggacccgggatgccattcagttactcatcttttatgctttcgtcctgacctgtctcaactagacttgctcctgcaaccaccatgggggttttgcatttacatttgtggaccatgttacagttaagaaaaatcctgtttcagtccttatatgtaataaaatgttttatgatgtaa

SEQ ID NO: 119235 - DNA, 814 bp, Homo sapiens
  Payload ID: 3363
  Gene Symbol: C6orf229
  Gene Name: chromosome 6 open reading frame 229
  Uniprot ID: H3BNL8
  ENST ID: ENST00000565469
  CDS Start-End: 33-725
tgtacctgaaggaccactggcctttttacacaatggctaacagccgattttcttgtacgcaaatttgggttaagatgtatgggtattttgcggggctgtgtcggcgtctccagaaattctggcgtgtcactgttaagggcttttttgttaagaagaaggaaaaaaaaatcccttcagctgagacttattttcatgaggaaaaaattgttgtacttggccaagtgttgatgaatgaatctctacccattgagaagagagctcaagctgcccagaaaattggactgctggccttcacaggaggaccacctgctgggaactttgcagctgagtacatggaagaagtggctcacttgttgcaagatgaggagttggcaccaaaaataaagatcctgctgctccagagtgtggcatgttggtgttacttaaaccctgtcagccagaaaagagccaaaagtctgcaatttattcctattctcattagtttttttgaaggcagattcgagtctactatcaaaagtgaaacaaacagctacctcctccttaaattttggacttgttacgttctctctgtcatgacatgcaataacttgtcttgcgtcaaggagcttaaagaccacagtgctctaaaatatcatttgcaaatgttggctgctgagaattggtctggatggacagagaattttgcagaggtgctgtatttcctaattggttttcataggaattagtttctctaaatccagttacatgttgcagctctctgtgtattaccctggaaaactgaaataaacaataaaaatcgatgttttcctttgta

SEQ ID NO: 119236 - DNA, 613 bp, Homo sapiens
  Payload ID: 3364
  Gene Symbol: C6orf25
  Gene Name: chromosome 6 open reading frame 25
  Uniprot ID: O95866
  ENST ID: ENST00000375804
  CDS Start-End: 1-582
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 119237 - DNA, 668 bp, Homo sapiens
  Payload ID: 3364
  Gene Symbol: C6orf25
  Gene Name: chromosome 6 open reading frame 25
  Uniprot ID: O95866
  ENST ID: ENST00000375805
  CDS Start-End: 15-668
accacatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 119238 - DNA, 833 bp, Homo sapiens
  Payload ID: 3364
  Gene Symbol: C6orf25
  Gene Name: chromosome 6 open reading frame 25
  Uniprot ID: O95866
  ENST ID: ENST00000375806
  CDS Start-End: 1-726
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtataga

SEQ ID NO: 119239 - DNA, 2396 bp, Homo sapiens
  Payload ID: 3364
  Gene Symbol: C6orf25
  Gene Name: chromosome 6 open reading frame 25
  Uniprot ID: O95866
  ENST ID: ENST00000375809
  CDS Start-End: 12-725
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcgcaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgaa

SEQ ID NO: 119240 - DNA, 910 bp, Homo sapiens
  Payload ID: 3364
  Gene Symbol: C6orf25
  Gene Name: chromosome 6 open reading frame 25
  Uniprot ID: O95866
  ENST ID: ENST00000375810
  CDS Start-End: 41-709
cgctgattcgctcgcagcttctcctcaccacatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccggtaagggcatggggatgggaaggggatagccagaatctctgaggaaaatggaccaaaaaaaaaaaggcctgaaccccaaggaagactgtggagaccatcttgtcttcctccccttcctcctccagagcctgctctatgcggatctggaccatctagccctcagcaggccccgccggctgtccacagcggaccctgctgatgcctccaccatctatgcagttgtagtttga

SEQ ID NO: 119241 - DNA, 594 bp, Homo sapiens
  Payload ID: 3364
  Gene Symbol: C6orf25
  Gene Name: chromosome 6 open reading frame 25
  Uniprot ID: O95866
  ENST ID: ENST00000375814
  CDS Start-End: 1-594
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 119242 - DNA, 2230 bp, Homo sapiens
  Payload ID: 3364
  Gene Symbol: C6orf25
  Gene Name: chromosome 6 open reading frame 25
  Uniprot ID: O95866
  ENST ID: ENST00000383410
  CDS Start-End: 1-594
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119243 - DNA, 2290 bp, Homo sapiens
  Payload ID: 3364
  Gene Symbol: C6orf25
  Gene Name: chromosome 6 open reading frame 25
  Uniprot ID: O95866
  ENST ID: ENST00000383411
  CDS Start-End: 1-654
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119244 - DNA, 2392 bp, Homo sapiens
  Payload ID: 3364
  Gene Symbol: C6orf25
  Gene Name: chromosome 6 open reading frame 25
  Uniprot ID: O95866
  ENST ID: ENST00000383412
  CDS Start-End: 12-725
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119245 - DNA, 2249 bp, Homo sapiens
  Payload ID: 3364
  Gene Symbol: C6orf25
  Gene Name: chromosome 6 open reading frame 25
  Uniprot ID: O95866
  ENST ID: ENST00000400067
  CDS Start-End: 1-582
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119246 - DNA, 2362 bp, Homo sapiens
  Payload ID: 3364
  Gene Symbol: C6orf25
  Gene Name: chromosome 6 open reading frame 25
  Uniprot ID: O95866
  ENST ID: ENST00000400071
  CDS Start-End: 1-726
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119247 - DNA, 2230 bp, Homo sapiens
  Payload ID: 3364
  Gene Symbol: C6orf25
  Gene Name: chromosome 6 open reading frame 25
  Uniprot ID: O95866
  ENST ID: ENST00000449633
  CDS Start-End: 1-594
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119248 - DNA, 2249 bp, Homo sapiens
  Payload ID: 3364
  Gene Symbol: C6orf25
  Gene Name: chromosome 6 open reading frame 25
  Uniprot ID: O95866
  ENST ID: ENST00000440063
  CDS Start-End: 1-582
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119249 - DNA, 2392 bp, Homo sapiens
  Payload ID: 3364
  Gene Symbol: C6orf25
  Gene Name: chromosome 6 open reading frame 25
  Uniprot ID: O95866
  ENST ID: ENST00000426729
  CDS Start-End: 12-725
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119250 - DNA, 2230 bp, Homo sapiens; identical to SEQ ID NO: 119247
  Payload ID: 3364
  Gene Symbol: C6orf25
  Gene Name: chromosome 6 open reading frame 25
  Uniprot ID: O95866
  ENST ID: ENST00000431888
  CDS Start-End: 1-594

SEQ ID NO: 119251 - DNA, 2362 bp, Homo sapiens
  Payload ID: 3364
  Gene Symbol: C6orf25
  Gene Name: chromosome 6 open reading frame 25
  Uniprot ID: O95866
  ENST ID: ENST00000457884
  CDS Start-End: 1-726
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119252 - DNA, 2249 bp, Homo sapiens; identical to SEQ ID NO: 119248
  Payload ID: 3364
  Gene Symbol: C6orf25
  Gene Name: chromosome 6 open reading frame 25
  Uniprot ID: O95866
  ENST ID: ENST00000425998
  CDS Start-End: 1-582

SEQ ID NO: 119253 - DNA, 2249 bp, Homo sapiens; identical to SEQ ID NO: 119248
  Payload ID: 3364
  Gene Symbol: C6orf25
  Gene Name: chromosome 6 open reading frame 25
  Uniprot ID: O95866
  ENST ID: ENST00000411608
  CDS Start-End: 1-582

SEQ ID NO: 119254 - DNA, 2230 bp, Homo sapiens; identical to SEQ ID NO: 119247
  Payload ID: 3364
  Gene Symbol: C6orf25
  Gene Name: chromosome 6 open reading frame 25
  Uniprot ID: O95866
  ENST ID: ENST00000415984
  CDS Start-End: 1-594

SEQ ID NO: 119255 - DNA, 2290 bp, Homo sapiens
  Payload ID: 3364
  Gene Symbol: C6orf25
  Gene Name: chromosome 6 open reading frame 25
  Uniprot ID: O95866
  ENST ID: ENST00000457450
  CDS Start-End: 1-654
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119256 - DNA, 2392 bp, Homo sapiens; identical to SEQ ID NO: 119249
  Payload ID: 3364
  Gene Symbol: C6orf25
  Gene Name: chromosome 6 open reading frame 25
  Uniprot ID: O95866
  ENST ID: ENST00000451549
  CDS Start-End: 12-725

SEQ ID NO: 119257 - DNA, 2290 bp, Homo sapiens; identical to SEQ ID NO: 119255
  Payload ID: 3364
  Gene Symbol: C6orf25
  Gene Name: chromosome 6 open reading frame 25
  Uniprot ID: O95866
  ENST ID: ENST00000445381
  CDS Start-End: 1-654

SEQ ID NO: 119258 - DNA, 2290 bp, Homo sapiens; identical to SEQ ID NO: 119255
  Payload ID: 3364
  Gene Symbol: C6orf25
  Gene Name: chromosome 6 open reading frame 25
  Uniprot ID: O95866
  ENST ID: ENST00000422012
  CDS Start-End: 1-654

SEQ ID NO: 119259 - DNA, 2290 bp, Homo sapiens; identical to SEQ ID NO: 119255
  Payload ID: 3364
  Gene Symbol: C6orf25
  Gene Name: chromosome 6 open reading frame 25
  Uniprot ID: O95866
  ENST ID: ENST00000435007
  CDS Start-End: 1-654

SEQ ID NO: 119260 - DNA, 2392 bp, Homo sapiens; identical to SEQ ID NO: 119249
  Payload ID: 3364
  Gene Symbol: C6orf25
  Gene Name: chromosome 6 open reading frame 25
  Uniprot ID: O95866
  ENST ID: ENST00000428302
  CDS Start-End: 12-725

SEQ ID NO: 119261 - DNA, 2362 bp, Homo sapiens; identical to SEQ ID NO: 119251
  Payload ID: 3364
  Gene Symbol: C6orf25
  Gene Name: chromosome 6 open reading frame 25
  Uniprot ID: O95866
  ENST ID: ENST00000436030
  CDS Start-End: 1-726

SEQ ID NO: 119262 - DNA, 2362 bp, Homo sapiens
  Payload ID: 3364
  Gene Symbol: C6orf25
  Gene Name: chromosome 6 open reading frame 25
  ENST ID: ENST00000441161
  CDS Start-End: 1-726
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattggaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119263 - DNA, 2392 bp, Homo sapiens
  Payload ID: 3364
  Gene Symbol: C6orf25
  Gene Name: chromosome 6 open reading frame 25
  ENST ID: ENST00000438769
  CDS Start-End: 12-725
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattggaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119264 - DNA, 2362 bp, Homo sapiens; identical to SEQ ID NO: 119251
  Payload ID: 3364
  Gene Symbol: C6orf25
  Gene Name: chromosome 6 open reading frame 25
  Uniprot ID: O95866
  ENST ID: ENST00000415728
  CDS Start-End: 1-726

SEQ ID NO: 119265 - DNA, 2249 bp, Homo sapiens; identical to SEQ ID NO: 119248
  Payload ID: 3364
  Gene Symbol: C6orf25
  Gene Name: chromosome 6 open reading frame 25
  Uniprot ID: O95866
  ENST ID: ENST00000417610
  CDS Start-End: 1-582

SEQ ID NO: 119266 - DNA, 2249 bp, Homo sapiens; identical to SEQ ID NO: 119248
  Payload ID: 3364
  Gene Symbol: C6orf25
  Gene Name: chromosome 6 open reading frame 25
  Uniprot ID: O95866
  ENST ID: ENST00000437153
  CDS Start-End: 1-582

SEQ ID NO: 119267 - DNA, 2230 bp, Homo sapiens; identical to SEQ ID NO: 119247
  Payload ID: 3364
  Gene Symbol: C6orf25
  Gene Name: chromosome 6 open reading frame 25
  Uniprot ID: O95866
  ENST ID: ENST00000433769
  CDS Start-End: 1-594

SEQ ID NO: 119268 - DNA, 2290 bp, Homo sapiens
  Payload ID: 3364
  Gene Symbol: C6orf25
  Gene Name: chromosome 6 open reading frame 25
  ENST ID: ENST00000442871
  CDS Start-End: 1-654
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatggcgcctgcccccgcaaccgattggaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaa

SEQ ID NO: 119269 - DNA, 2230 bp, Homo sapiens; identical to SEQ ID NO: 119247
  Payload ID: 3364
  Gene Symbol: C6orf25
  Gene Name: chromosome 6 open reading frame 25
  Uniprot ID: O95866
  ENST ID: ENST00000455185
  CDS Start-End: 1-594

SEQ ID NO: 119270 - DNA, 2392 bp, Homo sapiens; identical to SEQ ID NO: 119249
  Payload ID: 3364
  Gene Symbol: C6orf25
  Gene Name: chromosome 6 open reading frame 25
  Uniprot ID: O95866
  ENST ID: ENST00000444404
  CDS Start-End: 12-725

SEQ ID NO: 119271 - DNA, 2362 bp, Homo sapiens; identical to SEQ ID NO: 119251
  Payload ID: 3364
  Gene Symbol: C6orf25
  Gene Name: chromosome 6 open reading frame 25
  Uniprot ID: O95866
  ENST ID: ENST00000447587
  CDS Start-End: 1-726

SEQ ID NO: 119272 - DNA, 790 bp, Homo sapiens
  Payload ID: 3364
  Gene Symbol: C6orf25
  Gene Name: chromosome 6 open reading frame 25
  ENST ID: ENST00000480039
  CDS Start-End: 41-703
cgctgattcgctcgcagcttctcctcaccacatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccggtaagggcatggggatgggaaggggatagccagaatctctgaggaaaatggaccaaaaaaaaaaaggcctgaaccccaaggaagactgtggagaccatcttgtcttcctccccttcctcctccagagcc

SEQ ID NO: 119273 - DNA, 558 bp, Homo sapiens
  Payload ID: 3364
  Gene Symbol: C6orf25
  Gene Name: chromosome 6 open reading frame 25
  ENST ID: ENST00000485548
  CDS Start-End: 12-389
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctgctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcgga

SEQ ID NO: 119274 - DNA, 2475 bp, Homo sapiens
  Payload ID: 3365
  Gene Symbol: C6orf47
  Gene Name: chromosome 6 open reading frame 47
  Uniprot ID: O95873
  ENST ID: ENST00000375911
  CDS Start-End: 826-1710
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 119275 - DNA, 2473 bp, Homo sapiens
  Payload ID: 3365
  Gene Symbol: C6orf47
  Gene Name: chromosome 6 open reading frame 47
  Uniprot ID: O95873
  ENST ID: ENST00000366431
  CDS Start-End: 823-1707
gcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 119276 - DNA, 2475 bp, Homo sapiens
  Payload ID: 3365
  Gene Symbol: C6orf47
  Gene Name: chromosome 6 open reading frame 47
  Uniprot ID: O95873
  ENST ID: ENST00000366432
  CDS Start-End: 826-1710
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 119277 - DNA, 2475 bp, Homo sapiens; identical to SEQ ID NO: 119276
  Payload ID: 3365
  Gene Symbol: C6orf47
  Gene Name: chromosome 6 open reading frame 47
  Uniprot ID: O95873
  ENST ID: ENST00000413113
  CDS Start-End: 826-1710

SEQ ID NO: 119278 - DNA, 2475 bp, Homo sapiens; identical to SEQ ID NO: 119276
  Payload ID: 3365
  Gene Symbol: C6orf47
  Gene Name: chromosome 6 open reading frame 47
  Uniprot ID: O95873
  ENST ID: ENST00000418357
  CDS Start-End: 826-1710

SEQ ID NO: 119279 - DNA, 2475 bp, Homo sapiens
  Payload ID: 3365
  Gene Symbol: C6orf47
  Gene Name: chromosome 6 open reading frame 47
  Uniprot ID: O95873
  ENST ID: ENST00000431256
  CDS Start-End: 826-1710
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttgggacagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 119280 - DNA, 2476 bp, Homo sapiens
  Payload ID: 3365
  Gene Symbol: C6orf47
  Gene Name: chromosome 6 open reading frame 47
  Uniprot ID: O95873
  ENST ID: ENST00000442972
  CDS Start-End: 826-1710
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctggggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccag

SEQ ID NO: 119281 - DNA, 586 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375633
  CDS Start-End: 258-485
tgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagaa

SEQ ID NO: 119282 - DNA, 610 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375635
  CDS Start-End: 285-512
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119283 - DNA, 847 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375638
  CDS Start-End: 522-749
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119284 - DNA, 712 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375639
  CDS Start-End: 387-614
ttttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119285 - DNA, 1053 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375640
  CDS Start-End: 728-955
gctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119286 - DNA, 602 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375641
  CDS Start-End: 277-504
ggagcagcacccggctggcgctggccggccggcgccggggactttcttccgcctggccagacagatccctgttttttgtttttcaaaattcagaaagcatctccgaatatttgcccagaggagtgtgaaacatactttcctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119287 - DNA, 962 bp, Homo sapiens
  Payload ID: 3366
  Gene Symbol: C6orf48
  Gene Name: chromosome 6 open reading frame 48
  Uniprot ID: Q9UBA6
  ENST ID: ENST00000375642
  CDS Start-End: 637-864
ttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119288 - DNA, 847 bp, Homo sapiens; identical to SEQ ID NO: 119283
  Payload ID: 3366
  Gene Symbol: C6orf48
  Gene Name: chromosome 6 open reading frame 48
  Uniprot ID: Q9UBA6
  ENST ID: ENST00000383383
  CDS Start-End: 522-749

SEQ ID NO: 119289 - DNA, 610 bp, Homo sapiens; identical to SEQ ID NO: 119282
  Payload ID: 3366
  Gene Symbol: C6orf48
  Gene Name: chromosome 6 open reading frame 48
  Uniprot ID: Q9UBA6
  ENST ID: ENST00000383384
  CDS Start-End: 285-512

SEQ ID NO: 119290 - DNA, 712 bp, Homo sapiens; identical to SEQ ID NO: 119284
  Payload ID: 3366
  Gene Symbol: C6orf48
  Gene Name: chromosome 6 open reading frame 48
  Uniprot ID: Q9UBA6
  ENST ID: ENST00000383385
  CDS Start-End: 387-614

SEQ ID NO: 119291 - DNA, 815 bp, Homo sapiens
  Payload ID: 3366
  Gene Symbol: C6orf48
  Gene Name: chromosome 6 open reading frame 48
  Uniprot ID: Q9UBA6
  ENST ID: ENST00000395788
  CDS Start-End: 487-714
taaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagaa

SEQ ID NO: 119292 - DNA, 952 bp, Homo sapiens
  Payload ID: 3366
  Gene Symbol: C6orf48
  Gene Name: chromosome 6 open reading frame 48
  Uniprot ID: Q9UBA6
  ENST ID: ENST00000395789
  CDS Start-End: 627-854
ctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagacagggcgcaatgccaggatctccctgcaacatccaccgtcagggctcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119293 - DNA, 585 bp, Homo sapiens
  Payload ID: 3366
  Gene Symbol: C6orf48
  Gene Name: chromosome 6 open reading frame 48
  Uniprot ID: Q9UBA6
  ENST ID: ENST00000400034
  CDS Start-End: 260-487
tctgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119294 - DNA, 952 bp, Homo sapiens; identical to SEQ ID NO: 119292
  Payload ID: 3366
  Gene Symbol: C6orf48
  Gene Name: chromosome 6 open reading frame 48
  Uniprot ID: Q9UBA6
  ENST ID: ENST00000400035
  CDS Start-End: 627-854

SEQ ID NO: 119295 - DNA, 962 bp, Homo sapiens; identical to SEQ ID NO: 119287
  Payload ID: 3366
  Gene Symbol: C6orf48
  Gene Name: chromosome 6 open reading frame 48
  Uniprot ID: Q9UBA6
  ENST ID: ENST00000400037
  CDS Start-End: 637-864

SEQ ID NO: 119296 - DNA, 602 bp, Homo sapiens; identical to SEQ ID NO: 119286
  Payload ID: 3366
  Gene Symbol: C6orf48
  Gene Name: chromosome 6 open reading frame 48
  Uniprot ID: Q9UBA6
  ENST ID: ENST00000400038
  CDS Start-End: 277-504

SEQ ID NO: 119297 - DNA, 815 bp, Homo sapiens; identical to SEQ ID NO: 119291
  Payload ID: 3366
  Gene Symbol: C6orf48
  Gene Name: chromosome 6 open reading frame 48
  Uniprot ID: Q9UBA6
  ENST ID: ENST00000400039
  CDS Start-End: 487-714

SEQ ID NO: 119298 - DNA, 815 bp, Homo sapiens; identical to SEQ ID NO: 119291
  Payload ID: 3366
  Gene Symbol: C6orf48
  Gene Name: chromosome 6 open reading frame 48
  Uniprot ID: Q9UBA6
  ENST ID: ENST00000439907
  CDS Start-End: 487-714

SEQ ID NO: 119299 - DNA, 1053 bp, Homo sapiens; identical to SEQ ID NO: 119285
  Payload ID: 3366
  Gene Symbol: C6orf48
  Gene Name: chromosome 6 open reading frame 48
  Uniprot ID: Q9UBA6
  ENST ID: ENST00000414536
  CDS Start-End: 728-955

SEQ ID NO: 119300 - DNA, 602 bp, Homo sapiens; identical to SEQ ID NO: 119286
  Payload ID: 3366
  Gene Symbol: C6orf48
  Gene Name: chromosome 6 open reading frame 48
  Uniprot ID: Q9UBA6
  ENST ID: ENST00000456268
  CDS Start-End: 277-504

SEQ ID NO: 119301 - DNA, 952 bp, Homo sapiens; identical to SEQ ID NO: 119292
  Payload ID: 3366
  Gene Symbol: C6orf48
  Gene Name: chromosome 6 open reading frame 48
  Uniprot ID: Q9UBA6
  ENST ID: ENST00000436558
  CDS Start-End: 627-854

SEQ ID NO: 119302 - DNA, 847 bp, Homo sapiens; identical to SEQ ID NO: 119283
  Payload ID: 3366
  Gene Symbol: C6orf48
  Gene Name: chromosome 6 open reading frame 48
  Uniprot ID: Q9UBA6
  ENST ID: ENST00000423640
  CDS Start-End: 522-749

SEQ ID NO: 119303 - DNA, 847 bp, Homo sapiens; identical to SEQ ID NO: 119283
  Payload ID: 3366
  Gene Symbol: C6orf48
  Gene Name: chromosome 6 open reading frame 48
  Uniprot ID: Q9UBA6
  ENST ID: ENST00000414434
  CDS Start-End: 522-749

SEQ ID NO: 119304 - DNA, 815 bp, Homo sapiens; identical to SEQ ID NO: 119291
  Payload ID: 3366
  Gene Symbol: C6orf48
  Gene Name: chromosome 6 open reading frame 48
  Uniprot ID: Q9UBA6
  ENST ID: ENST00000421039
  CDS Start-End: 487-714

SEQ ID NO: 119305 - DNA, 1053 bp, Homo sapiens
  Payload ID: 3366
  Gene Symbol: C6orf48
  Gene Name: chromosome 6 open reading frame 48
  Uniprot ID: Q9UBA6
  ENST ID: ENST00000450610
  CDS Start-End: 728-955
gctgctgggaaacggcttaggagcagcacccggctggcgctggccggccggcgccggggactttcttccgcctggccagacagatccctgttttttgtttttcaaaattcagaaagcatctccgaatatttgcccagaggagtgtgaaacatacttccctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119306 - DNA, 962 bp, Homo sapiens; identical to SEQ ID NO: 119287
  Payload ID: 3366
  Gene Symbol: C6orf48
  Gene Name: chromosome 6 open reading frame 48
  Uniprot ID: Q9UBA6
  ENST ID: ENST00000440361
  CDS Start-End: 637-864

SEQ ID NO: 119307 - DNA, 712 bp, Homo sapiens; identical to SEQ ID NO: 119284
  Payload ID: 3366
  Gene Symbol: C6orf48
  Gene Name: chromosome 6 open reading frame 48
  Uniprot ID: Q9UBA6
  ENST ID: ENST00000444331
  CDS Start-End: 387-614

SEQ ID NO: 119308 - DNA, 585 bp, Homo sapiens; identical to SEQ ID NO: 119293
  Payload ID: 3366
  Gene Symbol: C6orf48
  Gene Name: chromosome 6 open reading frame 48
  Uniprot ID: Q9UBA6
  ENST ID: ENST00000426843
  CDS Start-End: 260-487

SEQ ID NO: 119309 - DNA, 712 bp, Homo sapiens; identical to SEQ ID NO: 119284
  Payload ID: 3366
  Gene Symbol: C6orf48
  Gene Name: chromosome 6 open reading frame 48
  Uniprot ID: Q9UBA6
  ENST ID: ENST00000413638
  CDS Start-End: 387-614

SEQ ID NO: 119310 - DNA, 712 bp, Homo sapiens; identical to SEQ ID NO: 119284
  Payload ID: 3366
  Gene Symbol: C6orf48
  Gene Name: chromosome 6 open reading frame 48
  Uniprot ID: Q9UBA6
  ENST ID: ENST00000435938
  CDS Start-End: 387-614

SEQ ID NO: 119311 - DNA, 952 bp, Homo sapiens; identical to SEQ ID NO: 119292
  Payload ID: 3366
  Gene Symbol: C6orf48
  Gene Name: chromosome 6 open reading frame 48
  Uniprot ID: Q9UBA6
  ENST ID: ENST00000436495
  CDS Start-End: 627-854

SEQ ID NO: 119312 - DNA, 962 bp, Homo sapiens; identical to SEQ ID NO: 119287
  Payload ID: 3366
  Gene Symbol: C6orf48
  Gene Name: chromosome 6 open reading frame 48
  Uniprot ID: Q9UBA6
  ENST ID: ENST00000423916
  CDS Start-End: 637-864

SEQ ID NO: 119313 - DNA, 602 bp, Homo sapiens; identical to SEQ ID NO: 119286
  Payload ID: 3366
  Gene Symbol: C6orf48
  Gene Name: chromosome 6 open reading frame 48
  Uniprot ID: Q9UBA6
  ENST ID: ENST00000439865
  CDS Start-End: 277-504

SEQ ID NO: 119314 - DNA, 585 bp, Homo sapiens; identical to SEQ ID NO: 119293
  Payload ID: 3366
  Gene Symbol: C6orf48
  Gene Name: chromosome 6 open reading frame 48
  Uniprot ID: Q9UBA6
  ENST ID: ENST00000416886
  CDS Start-End: 260-487

SEQ ID NO: 119315 - DNA, 602 bp, Homo sapiens
  Payload ID: 3366
  Gene Symbol: C6orf48
  Gene Name: chromosome 6 open reading frame 48
  Uniprot ID: Q9UBA6
  ENST ID: ENST00000433697
  CDS Start-End: 277-504
ggagcagcacccggctggcgctggccggccggcgccggggactttcttccgcctggccagacagatccctgttttttgtttttcaaaattcagaaagcatctccgaatatttgcccagaggagtgtgaaacatacttccctggagttgtaagacgttcatcgccgtgttatccttgagtaaagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaa

SEQ ID NO: 119316 - DNA, 952 bp, Homo sapiens; identical to SEQ ID NO: 119292
  Payload ID: 3366
  Gene Symbol: C6orf48
  Gene Name: chromosome 6 open reading frame 48
  Uniprot ID: Q9UBA6
  ENST ID: ENST00000443974
  CDS Start-End: 627-854

SEQ ID NO: 119317 - DNA, 1053 bp, Homo sapiens; identical to SEQ ID NO: 119285
  Payload ID: 3366
  Gene Symbol: C6orf48
  Gene Name: chromosome 6 open reading frame 48
  Uniprot ID: Q9UBA6
  ENST ID: ENST00000444974
  CDS Start-End: 728-955

SEQ ID NO: 119318 - DNA, 610 bp, Homo sapiens; identical to SEQ ID NO: 119282
  Payload ID: 3366
  Gene Symbol: C6orf48
  Gene Name: chromosome 6 open reading frame 48
  Uniprot ID: Q9UBA6
  ENST ID: ENST00000421605
  CDS Start-End: 285-512

SEQ ID NO: 119319 - DNA, 610 bp, Homo sapiens; identical to SEQ ID NO: 119282
  Payload ID: 3366
  Gene Symbol: C6orf48
  Gene Name: chromosome 6 open reading frame 48
  Uniprot ID: Q9UBA6
  ENST ID: ENST00000458514
  CDS Start-End: 285-512

SEQ ID NO: 119320 - DNA, 815 bp, Homo sapiens
  Payload ID: 3366
  Gene Symbol: C6orf48
  Gene Name: chromosome 6 open reading frame 48
  Uniprot ID: Q9UBA6
  ENST ID: ENST00000436205
  CDS Start-End: 487-714
taaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagga

SEQ ID NO: 119321 - DNA, 962 bp, Homo sapiens; identical to SEQ ID NO: 119287
  Payload ID: 3366
  Gene Symbol: C6orf48
  Gene Name: chromosome 6 open reading frame 48
  Uniprot ID: Q9UBA6
  ENST ID: ENST00000430690
  CDS Start-End: 637-864

SEQ ID NO: 119322 - DNA, 847 bp, Homo sapiens; identical to SEQ ID NO: 119283
  Payload ID: 3366
  Gene Symbol: C6orf48
  Gene Name: chromosome 6 open reading frame 48
  Uniprot ID: Q9UBA6
  ENST ID: ENST00000433752
  CDS Start-End: 522-749

SEQ ID NO: 119323 - DNA, 585 bp, Homo sapiens; identical to SEQ ID NO: 119293
  Payload ID: 3366
  Gene Symbol: C6orf48
  Gene Name: chromosome 6 open reading frame 48
  Uniprot ID: Q9UBA6
  ENST ID: ENST00000456690
  CDS Start-End: 260-487

SEQ ID NO: 119324 - DNA, 1053 bp, Homo sapiens; identical to SEQ ID NO: 119285
  Payload ID: 3366
  Gene Symbol: C6orf48
  Gene Name: chromosome 6 open reading frame 48
  Uniprot ID: Q9UBA6
  ENST ID: ENST00000424962
  CDS Start-End: 728-955

SEQ ID NO: 119325 - DNA, 610 bp, Homo sapiens; identical to SEQ ID NO: 119282
  Payload ID: 3366
  Gene Symbol: C6orf48
  Gene Name: chromosome 6 open reading frame 48
  Uniprot ID: Q9UBA6
  ENST ID: ENST00000444192
  CDS Start-End: 285-512

SEQ ID NO: 119326 - DNA, 748 bp, Homo sapiens
  Payload ID: 3366
  Gene Symbol: C6orf48
  Gene Name: chromosome 6 open reading frame 48
  Uniprot ID: Q9UBA6
  ENST ID: ENST00000550492
  CDS Start-End: 418-645
gcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaaggtgaaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaagaaga

SEQ ID NO: 119327 - DNA, 748 bp, Homo sapiens; identical to SEQ ID NO: 119326
  Payload ID: 3366
  Gene Symbol: C6orf48
  Gene Name: chromosome 6 open reading frame 48
  Uniprot ID: Q9UBA6
  ENST ID: ENST00000550685
  CDS Start-End: 418-645

SEQ ID NO: 119328 - DNA, 748 bp, Homo sapiens; identical to SEQ ID NO: 119326
  Payload ID: 3366
  Gene Symbol: C6orf48
  Gene Name: chromosome 6 open reading frame 48
  Uniprot ID: Q9UBA6
  ENST ID: ENST00000549426
  CDS Start-End: 418-645

SEQ ID NO: 119329 - DNA, 748 bp, Homo sapiens
  Payload ID: 3366
  Gene Symbol: C6orf48
  Gene Name: chromosome 6 open reading frame 48
  Uniprot ID: Q9UBA6
  ENST ID: ENST00000552514
  CDS Start-End: 418-645
gcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaaggtgaaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagtaaaggaga

SEQ ID NO: 119330 - DNA, 748 bp, Homo sapiens; identical to SEQ ID NO: 119326
  Payload ID: 3366
  Gene Symbol: C6orf48
  Gene Name: chromosome 6 open reading frame 48
  Uniprot ID: Q9UBA6
  ENST ID: ENST00000614363
  CDS Start-End: 418-645

SEQ ID NO: 119331 - DNA, 619 bp, Homo sapiens
  Payload ID: 3367
  Gene Symbol: C6orf52
  Gene Name: chromosome 6 open reading frame 52
  Uniprot ID: Q5T4I8
  ENST ID: ENST00000259983
  CDS Start-End: 125-583
cggttgcttaggggctgtagcgccggcagcgtgcattgttgtgggctgtgtactagtagggtaggagtttttgttcagggaccagcggaacgaggctttctgtcgttaataggtttctgggtaaatggcccaaccagagagttctgcagattttggcatagctcaacaaaataactattactgctactggcaaagtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcatact

SEQ ID NO: 119332 - DNA, 430 bp, Homo sapiens
  Payload ID: 3367
  Gene Symbol: C6orf52
  Gene Name: chromosome 6 open reading frame 52
  Uniprot ID: Q5T4I8
  ENST ID: ENST00000379586
  CDS Start-End: 199-396
ggccggttgcttaggggctgtagcgccggcagcgtgcattgttgtgggctgtgtactagtagggtaggagtttttgttcagggaccagcggaacgaggctttctgtcgttaataggctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcata

SEQ ID NO: 119333 - DNA, 493 bp, Homo sapiens
  Payload ID: 3367
  Gene Symbol: C6orf52
  Gene Name: chromosome 6 open reading frame 52
  Uniprot ID: Q5T4I8
  ENST ID: ENST00000426700
  CDS Start-End: 1-459
atggcccaaccagagagttctgcagattttggcatagctcaacaaaataactattactgctactggcaaagtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaaggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcata

SEQ ID NO: 119334 - DNA, 541 bp, Homo sapiens
  Payload ID: 3367
  Gene Symbol: C6orf52
  Gene Name: chromosome 6 open reading frame 52
  ENST ID: ENST00000460742
  CDS Start-End: 312-503
ttcagggaccagcggaacgaggctttctgtcgttaataggtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaagtgaccccctgtgccatctgcctgccatcctgctgggtgtcccctgttgggaagctgctgagtgaaattaaagatggaaaccacacctctagctgaaaaccaagatgaagacccactagaagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcatactaa

SEQ ID NO: 119335 - DNA, 682 bp, Homo sapiens
  Payload ID: 3367
  Gene Symbol: C6orf52
  Gene Name: chromosome 6 open reading frame 52
  ENST ID: ENST00000503680
  CDS Start-End: 367-648
gattttccaagaagagaataagtaaagatgccacatgaggaggttctcactgcaaggagaaaaaaatcgggggcaagcaggcatatctcaggaagtctcccctctgctattagagtgaagcaggagttccagcccagccagagttaccgctatggcaactggtatgcgcgacagcacggctcttaccttctttctggctacagctatggctgtgcagtggatggaaatggaaaggactgtttttctgcgcatgagacccctgaacacacagctggaactctggttatgcctaagtgaccccctgtgccatctgcctgccatcctgctgggtgtcccctgttgggaagctgctgagtgaaattaaagatggaaaccacacctctagctgaaaaccaagatgaagacccactagaagtgacgtctcagtatgttgcccaggctgatctcaaactcccagatttaagcaattcactggtctcagcttcccaaagtgttggggttacagatccacatcttcatttgaatattgaggaatcaaaccaagagtttatggtgaaaagtgaagaactctacgactccctcatgaattgccactggcagcctctggacacagttcactccgaaatcccagatgagaccccgaagtgaagcaaggtgttcattaaactccgcaattatcata

SEQ ID NO: 119336 - DNA, 1200 bp, Homo sapiens
  Payload ID: 3368
  Gene Symbol: C6orf58
  Gene Name: chromosome 6 open reading frame 58
  Uniprot ID: Q6P5S2
  ENST ID: ENST00000329722
  CDS Start-End: 13-1005
agctctggcacaatggcttttcttccttcctgggtttgtgtactagttggttccttttctgcttccttagcagggacttccaatctctcagagacagagccccctctgtggaaggagagtcctggtcagctcagtgactacagggtggagaacagcatgtacattattaatccctgggtataccttgagagaatggggatgtataaaatcatattgaatcagacagccaggtattttgcaaaatttgcaccagataatgaacagaatattttatgggggttgcctctgcagtatggctggcaatataggacaggcagattagctgatccaacccgaaggacaaactgtggctatgaatctggagatcatatgtgcatctctgtggacagttggtgggctgatttgaattattttctgtcttcattaccctttcttgctgcggttgattctggtgtaatggggatatcatcagaccaagtcaggcttttgcccccacccaagaatgagaggaagttttgttatgatgtttctagctgtcgttcatccttccctgagacaatgaacaagtggaacaccttttaccagtatttgcagtcaccttttagtaagtttgatgatctgttgaagtacttatgggctgcacacacttcaaccttggcagataatatcaaaagttttgaagacagatatgattattattctaaagcagaagcgcattttgagagaagttgggtactggctgtggatcatttagctgcagtcctctttcctacaaccttgattagatcatataagttccagaagggcatgccaccacgaattcttcttaatactgatgtagcccctttcatcagtgactttactgcttttcagaatgtagtcctggttcttctaaatatgcttgacaatgtggataaatctataggttatctttgtacagaaaaatctaatgtatatagagatcattcggaatctagctctagaagttatggaaataactcctgaaacatttaacttcaaacttcaggaaatgattaatgaattaaaaatgaaaaactcgaacttgacaatcagtaatttcaaaaaattaatgtcatcatgaccatgtagtttattctttctgatatttttgatttatgcttatttgttaagatcttgtacatgtattaaaaacttaaattaaatgcattcaagttaaaa

SEQ ID NO: 119337 - DNA, 741 bp, Homo sapiens
  Payload ID: 3369
  Gene Symbol: C6orf62
  Gene Name: chromosome 6 open reading frame 62
  Uniprot ID: Q9GZU0
  ENST ID: ENST00000378102
  CDS Start-End: 98-700
atattaacacaattattttctttttttcccccactgaaccttcccatttaccctctcccgcccactccacccgggcgggaattgtttccacgatgaaatgagtgaaaacctgagtgatcctgtgtctcccgtggtgcgaaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagca

SEQ ID NO: 119338 - DNA, 4134 bp, Homo sapiens
  Payload ID: 3369
  Gene Symbol: C6orf62
  Gene Name: chromosome 6 open reading frame 62
  Uniprot ID: Q9GZU0
  ENST ID: ENST00000378119
  CDS Start-End: 2169-2858
aaacgcgactctgccccggacccgcgaggcgcccgaggccttcgccgcttctgcagccaccggcgggggggggaacgaggcagtactgccgcggacgctcaccaaccgcttcggcttttcccccctccgggtctcctcgacctttcctgagagccggaatccgactgtagggggaagaaagactcaagagcagatgcttgaactgaaataactttattttggggggttactttgctgacccttagcgcagggcttcctttcccttccccctccgccgccagtaccaatccaactccccatctttctctttgtttttcctctttttctttttctctccctgttgccgctgtctccgcgtccttcccctccgttgccgcccagggcgccgagccagactatgggtcccaggtgggggctgagcggcggcagcagcgcgggcggtccagtcacggtgcgcactgcagcggggatggaggggctcagttggctggtggttttctcttgacatggctcctgcccgtgctaccagcagcgcccccgccgccgccgcctcttccgccgccgccaccgctccgcccgcaggctgcggctagagggcccaaaccccgccctagagtcggtccgtgagtcccgggctccgcggggacagggaggggatttccccgtcacccaccccgccctagctgcctcaattccaccccctgcccctcgggaaacaactaacgaccccaccctaaacaatccaaactctggaaacatggtctgttcaacgtgagagagagctaatccgggaacttaattttttggggggagggtgggtgggcttactttagaagtaatattaacacaattattttctttttttcccccactgaaccttcccatttaccctctcccgcccactccacccgggcgggaattgtttccacgatgaaatgagtgaaaacctgagtgatcctgtgtctcccgtggtgcgagtgagtcgctgccgctgaaggcaaggggtgggggtgggacctgcgggggtggaaggcaggtggtctccgggcaccgcctgggatttgggagaagaacccgccacctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggatgtaattggctgtactcaggagatggatttcattctttggcctcggaatgatattgaaaaaatcgtctgtctcctgttttctaggtggaaagaatctgatgagccttttaggcctgttcaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaa

SEQ ID NO: 119339 - DNA, 1309 bp, Homo sapiens
  Payload ID: 3370
  Gene Symbol: C6orf89
  Gene Name: chromosome 6 open reading frame 89
  Uniprot ID: Q6UWU4
  ENST ID: ENST00000355190
  CDS Start-End: 164-1228
gaagcgctggacgagaggaggaattactctagggtacaaggcctcgcccaggagtggggggttgcttccgggtcgcgctcccggaaacaggaagttgcccatcctcctcgcccggcggcagctgtccccgaggcgggaggagcccgaggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaa

SEQ ID NO: 119340 - DNA, 2565 bp, Homo sapiens
  Payload ID: 3370
  Gene Symbol: C6orf89
  Gene Name: chromosome 6 open reading frame 89
  ENST ID: ENST00000359359
  CDS Start-End: 726-1451
atgctgcagagggagaggacaacagctccagtaaacaaaaaggtcagggcagacaggagtattatggaactgctccaggactcttgattttcaagcttatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctg

SEQ ID NO: 119341 - DNA, 1400 bp, Homo sapiens
  Payload ID: 3370
  Gene Symbol: C6orf89
  Gene Name: chromosome 6 open reading frame 89
  Uniprot ID: Q6UWU4
  ENST ID: ENST00000373685
  CDS Start-End: 276-1319
gaagcgctggacgagaggaggaattactctagggtacaaggcctcgcccaggagtggggggttgcttccgggtcgcgctcccggaaacaggaagttgcccatcctcctcgcccggcggcagctgtccccgaggcgggaggagcccgaggggcgcgagccccgcatgtctatgccactgttagaatcaggctaactcttcagaacttccccctgtagcaaagctcactttggccagagttggaactactttctgcagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaa

SEQ ID NO: 119342 - DNA, 6861 bp, Homo sapiens
  Payload ID: 3370
  Gene Symbol: C6orf89
  Gene Name: chromosome 6 open reading frame 89
  Uniprot ID: Q6UWU4
  ENST ID: ENST00000480824
  CDS Start-End: 295-1338
gttttgggcggaagcgctggacgagaggaggaattactctagggtacaaggcctcgcccaggagtggggggttgcttccgggtcgcgctcccggaaacaggaagttgcccatcctcctcgcccggcggcagctgtccccgaggcgggaggagcccgaggggcgcgagccccgcatgaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcctccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggagtcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 119343 - DNA, 2451 bp, Homo sapiens
  Payload ID: 3371
  Gene Symbol: C7orf25
  Gene Name: chromosome 7 open reading frame 25
  Uniprot ID: Q9BPX7
  ENST ID: ENST00000350427
  CDS Start-End: 277-1542
cctcaataaacatggccgccacgccagcgtcaacccggctcgggaggccgcgctgccgcttgggaatcgcaggtttggcgtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattcaagcctgtttttcattgtattgctttatatggtttaggctgggaggtagtcgttggtaatcaattttagattctaaggttaaccattaatgaaaaacttatttgctgtatgtcaggtgcagtctgataggtgtttttacaaaaagtacataatacagaagaaatgagaaagtgaattatggttatttgagtgccatgaacccattggtagacctttgtgaaaagaaagccaacaatcttactactataagataaaaccaggacacttaaggtaaaatactaatttgaatgaattgaaaaaggattatgtaaaagattttaaaaattcaatacagaaagcccccatattataagtatttgaacaataaatactattttcatgtttcatttgcaagtggcaagtgacaactgcattaccttactttcatgagatggtgacagaatattccatgccaattccatgacacaagttgtagttaaaaatacacttctatggctacattgcgctagatactttatcagttttcaataaagcaaaactagcaaagtc

SEQ ID NO: 119344 - DNA, 1743 bp, Homo sapiens
  Payload ID: 3371
  Gene Symbol: C7orf25
  Gene Name: chromosome 7 open reading frame 25
  Uniprot ID: Q9BPX7
  ENST ID: ENST00000438029
  CDS Start-End: 465-1730
ggagccggggagcgaggcggggaggctgggagcggggcgcctcttctgaggccagagggggctgggcagggccggcccggcgggaagggggtcggccgcgcgctatcagcgcctggtccctgagccgcggcgctggcggtgggggcttttcggccccggcccctcctggcagggcccggctgtgcaggtggccgggcagggccgagggccccgcagcccaccgagaaggccccgccggcctctggcccgcccacccggcgacctgcgctggggccgcttgcacggccgccgcgggttgcagccttggagtttagtttcatcttcggattttccttcagagtcggagtgggagtgggacgcaagttggtggtcttcttcggtcttttaaaatagtctgggttgacgtcaaatgcagaaatgaggcagtgttgattttttttggcgaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaa

SEQ ID NO: 119345 - DNA, 1823 bp, Homo sapiens
  Payload ID: 3371
  Gene Symbol: C7orf25
  Gene Name: chromosome 7 open reading frame 25
  Uniprot ID: Q9BPX7
  ENST ID: ENST00000447342
  CDS Start-End: 24-1463
gtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattc

SEQ ID NO: 119346 - DNA, 637 bp, Homo sapiens
  Payload ID: 3371
  Gene Symbol: C7orf25
  Gene Name: chromosome 7 open reading frame 25
  ENST ID: ENST00000425683
  CDS Start-End: 104-637
gacccggttgcgatcgagtggccgacgcccccagtgggagtgaggcccagcacgcgagctcggtccctcttcctggagccaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggca

SEQ ID NO: 119347 - DNA, 1645 bp, Homo sapiens
  Payload ID: 3371
  Gene Symbol: C7orf25
  Gene Name: chromosome 7 open reading frame 25
  Uniprot ID: Q9BPX7
  ENST ID: ENST00000431882
  CDS Start-End: 24-1463
gtcacccggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagaga

SEQ ID NO: 119348 - DNA, 578 bp, Homo sapiens
  Payload ID: 3371
  Gene Symbol: C7orf25
  Gene Name: chromosome 7 open reading frame 25
  ENST ID: ENST00000432637
  CDS Start-End: 324-578
gtgctcgcgctcgcggttctggcgctgccggaccatgctgtgtccccatggctttcaagctgaagaaatgaaggtctaaagtgtgtcagacgtacctaaagaagagttcaaaagtgtagctgccatcctttccttagctatcagaggaagcagtcactccagaatgagacatacacaagcccgggttcatagactcaccctccataagctgtgttgctagattgaagtttttaatcaccagtgaagaattgattgtcataattttaggagactactgaagtttgccttgtttctttccctaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagtt

SEQ ID NO: 119349 - DNA, 2182 bp, Homo sapiens
  Payload ID: 3372
  Gene Symbol: C7orf26
  Gene Name: chromosome 7 open reading frame 26
  Uniprot ID: Q96N11
  ENST ID: ENST00000344417
  CDS Start-End: 268-1617
cggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcatcccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtca

SEQ ID NO: 119350 - DNA, 1762 bp, Homo sapiens
  Payload ID: 3372
  Gene Symbol: C7orf26
  Gene Name: chromosome 7 open reading frame 26
  Uniprot ID: Q96N11
  ENST ID: ENST00000359073
  CDS Start-End: 141-1199
ggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcatcccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagt

SEQ ID NO: 119351 - DNA, 675 bp, Homo sapiens
  Payload ID: 3372
  Gene Symbol: C7orf26
  Gene Name: chromosome 7 open reading frame 26
  ENST ID: ENST00000445375
  CDS Start-End: 1-448
caatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagactctgaatttcggggtcgtttgcaaggccagcttcctggggcttctgcttggaattcaggtagggcgcggtcattctcggctctgaggagactgtggccagctgttctgtgtgtcccagcgcagcagagagccgcagaggctgacgtggaggccacctgtgtgggctgcgcgcccgggagtgctacggccggagctccgtgggccacaggccccgtgcagagcccactcccacgcatcctcgcctgtggggtcctggctctgccactgcttctccgtgtccaccgcctggacccccgggtggtccgtgcctgt

SEQ ID NO: 119352 - DNA, 458 bp, Homo sapiens
  Payload ID: 3372
  Gene Symbol: C7orf26
  Gene Name: chromosome 7 open reading frame 26
  ENST ID: ENST00000440409
  CDS Start-End: 1-294
ctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagacggtagtgaggatgagacccagtggtgtttgtgaatttctcatcctactccttgccacgtggagacctccacaaacgcagtcatcaggactctgaatttcggggtcgtttgcaaggccagcttcctggggcttctgcttggaattcagcctcctccagctggtgatctcgggtcccgtgcagcagtcgcctcacgccgcgctccccccggggttctacccccacatccacacgcccccgctgggctacggggctgtccc

SEQ ID NO: 119353 - DNA, 2673 bp, Homo sapiens
  Payload ID: 3373
  Gene Symbol: C7orf31
  Gene Name: chromosome 7 open reading frame 31
  Uniprot ID: Q8N865
  ENST ID: ENST00000283905
  CDS Start-End: 664-2436
tcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggtatgtccagacccccgaggcaccgcttgcagggcagtgacagcccgtgaggctcggcctcgacccctggcacccttggtcccagctacgccggctcctggccttcccccaagtccgagagagaggtgggattctccccgacgcagttggaaaccgggaatcccctttagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcgccatgttccccaccttcacgtcacctgaggacctctacacgggcattaaagcccgcacccagcagccctttcctcccacggtgccaaccaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatt

SEQ ID NO: 119354 - DNA, 3357 bp, Homo sapiens
  Payload ID: 3373
  Gene Symbol: C7orf31
  Gene Name: chromosome 7 open reading frame 31
  Uniprot ID: Q8N865
  ENST ID: ENST00000409280
  CDS Start-End: 310-2082
agagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacatctgtcgcggcgccatgttccccaccttcacgtcacctgaggacctctacacgggcattaaagcccgcacccagcagccctttcctcccacggtgccaaccaaggcttatgattcaacagttttgaagacaagaggtaatccttatagatatgaactgattgatattcccatggattcaaagaagaaagcactgacttggccaggtcaaggtgtatattatgattttcccagaggtgttgagaaaaataagccagtattctacccaaaacctcctaaaaccttcgctcctaacacttctttaaattcatgggaccctatttgctctgccaaagaagccaacatacaaagaaatcttgagaggtcccactggctcacttcgtacactcatgattttacaggtctggggcccatggacccccttgaactggatgattaccatgaaaagatggtagcagagttaacacgaaagataggatttgacccagagccgcaagaaaaattccaccctgtcttcaaacctcccagaccgttggaaggacgaattgcccgattaattcagaaccgacgttctctggaggctatagtccagcaaagaccacgttcctgtccagattgtactcctagagttttgtgtaattttcatacctttgtacccagttctaaagaaatggtggcacttagtgataacataccagccggtgtgacccataaaaaccaggatattgaagagaagatcatagaagaacagagcttgctgtctacctatgaactcccatcttgttacccaacaaaagacctaactagcatttatgacataaagccatttccaaaaatcacagatactaaaaagacagaagatttatactggagacagcagtcactaaaaacccaacccacaccttactgtaaaccagaccactggattcactatgaaaatcttaaatctcccctacgtgatcagtataatatgtgtccagaccctgttagccttagtaaacctagtgttttacaaaataaacaagacacggaagctttcactttagaacattttttaagtaagccagaagaagagttgttcttgaatatggaaaacaatgaagaaacaagacctgttcttggttggattcctagagctggagtgaccaaacctcagaccaacctgctggagcttaagaactctttttcaaaaactggtgcacaaaagcgtttccataaatcaattctagaagaccataaagacctcagggataatgagcattcggggatgaagcaccaattctatggccataattcctattatttctataattgagatactcattcttcccttcaaaacccagcctcttgcaagaagctaaaaaatataacagaatttccttcgtattgctggattctgttttctagattaaaccacaaggaccttgttagtgaggtttacattttcaggaatttaagttagtatctggttggaggaacccagaaaaggtgatgttatgacttcttgaaaagtttaacaatttggcaataaaatattagaactagaaaaatttatagtctttaatctctcatcttcagattatacaaggaaattttccaaaatcacaaaaagcaatgtgtacaacaaagtttacatcattgtttcaccaaaaaaaattgaaaagctggaaagaactcaaatgatcaataattaatgaatgactatacaaattatagtatcttaataaaaatgagaacactgtccctttatgtaaatttttgtacatagtagcattaggtagaaaagacaaaacccaaacacctagttaattgagggatggacacctctaaaaactatattgtcttaaaagtatgtggactctgttcctttatgtaaacatgtaaagaaaataagtcagcgaaaaaaatgaaacccaaaactctctgcatgtacacattacaaattgaattgtttgcttacccttaaccttctgattgagaaacataactgtttcttttatgcagataaaattattttactgaagatctagcaatggccttaattagcaactggtgagttctaattatagcaagaaaggatggcttggtatcagttattacagagccccaaatcttcatttctggagtgtgttctctaagagtttggctaactcccatatgcaagtcaattcatttaatgtgccaagaggtagattttaaacatagtctatcgtggaagttcaagaggaatttctttaagtattttgtgaatatttattttaattttatgaccaacatgtcatttggttgtaacctccttaaaactattctgggctaaagttagagaatttttttccaactgcattctgtacagcactagttacattatgacaggaagtaaaagtttacatggtgaaataatactggggaaatcggagcaacaatgtcagttgcatgccttggtcactgggttctctatagcctttaatatgtaatgcaattgggagtgtctgaagtgagggagatatagtgtacacactttttatcacagagtagatcactggaatggaattccaaataataaactttggaaggtgtaactctccagtat

SEQ ID NO: 119355 - DNA, 555 bp, Homo sapiens
  Payload ID: 3373
  Gene Symbol: C7orf31
  Gene Name: chromosome 7 open reading frame 31
  ENST ID: ENST00000443822
  CDS Start-End: 95-555
agcagtgtaaaatgtgttttctgcctgccttgactcgacaagccaaatgtgccctccttttcttttccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgacccagaacaaaaaaagtgatgtctatggaaatgattctttgatacccaagccgcctaattcaacagtaggagagatctgcttgccatatccaattgaacacccctaccacacacacat

SEQ ID NO: 119356 - DNA, 757 bp, Homo sapiens
  Payload ID: 3373
  Gene Symbol: C7orf31
  Gene Name: chromosome 7 open reading frame 31
  ENST ID: ENST00000415598
  CDS Start-End: 411-757
gaagagcccctctcgcctccgacccggcgcctcgcactccgttcactctcggttcctcttcgcattcttgccagtcccgtagcgctgggctggtttcctccgaggtctctaagagcctcctactgcgccccgctcgccgcccggaagcccccagcccctcaaggacgcatcacctaatgccgcggtcacggccaccgtcacaagcgcccccagccccaccccaccccggcctgcccgccgtccttctcccgcccccgcccctgcctgccagctccaccgggccgtaggtgcggacgacctcaaaattcctcggcccgcgaaggccgccagctgcggggaggggaggggaggcgcggtcccgcagcgcccccaggctcatgtcccaggttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatcagcattatggatttggtggagaaacctggccaagaaagcttcctgttgaacaattttattatttgaccca

SEQ ID NO: 119357 - DNA, 519 bp, Homo sapiens
  Payload ID: 3373
  Gene Symbol: C7orf31
  Gene Name: chromosome 7 open reading frame 31
  ENST ID: ENST00000444434
  CDS Start-End: 242-519
ctcggcccgcgaaggccgccagctgcggggaggggaggggaggcgcggtcccgcagcgcccccaggctcatgtcccagggtcccgttcgtgctgcactactgactccaccatctgcaaagggattcttgtccagaatccccgaaggctttaggacagcgcttattttgttgaatgaagagtctctaattttcggaaagaccacaggctaaaagtcaagttgtgcctttttagccaagaagcatggaagtcattcacggcaggccctactgttgcagggagcttgaaggagctgacatactgtccaacaccttttactctaatgaattgcacaaccccctccagacggttactcgcccaactgcctcagaggacaggtatcaggaattaagggagtcacttcaacaatgtaggcttccttggggcgctgaaagagagtatggtgggataataccgatttcactccccgaggaccacaggccaaagtatgagcctcctcgtgtcatgggcaaaggacatca

SEQ ID NO: 119358 - DNA, 1354 bp, Homo sapiens
  Payload ID: 3374
  Gene Symbol: C7orf33
  Gene Name: chromosome 7 open reading frame 33
  Uniprot ID: Q8WU49
  ENST ID: ENST00000307003
  CDS Start-End: 362-895
gagctgcaggcaacgtgatctgaattacatggaggacaagctccagctgactttccgtaaactcgcattaggattctaataggagacgacaggagcaggtggggataatgagctggcggaaggggctgcctatcacactgctcggtggcccctctttcacccccactttgcctcaggcattttctactcagctgtgaccttacttatggtgatgccaatccagtggtcaggagcgaggcgcccagcctgtgtctgaatcctcctactgaccctggggatccgtgcgacttgatcttagatattggtggtgaagcgccgctctccttgacagcatccaggaaaggtaattacctttgccaaaatgcaagtggaagttcaaagcctcagccttgaagagtgtccctggagacttccaggcccccaatgtgaatgtgaagccctcctgcccagtggggcaaggcgccggattgaccttcgcctgagtgggagggcagtcgctgtttgggtccacgttaggggcggtccaggtcaatttaacttgtcatatgccacgggaagacataagaagccaaacccacaccaaaacatgaaccgggggatggaatttattgctcctgtatcagctcccaccaaatctggtgccccgtggcattttctttctcaaggtcccacggatgcccagagagcagtcagaatcaggccaggcaccaggatgggcttgtcctcagatccagttgtcggcaccttgtcttccagttacctagatctgctaactctctcttacaagcctgggaggacagtgacaagttcatacctaaacgtacgtgggcatgaagtaagaaagctccagaattctgttgaggccacaaggatttccagaactgacagcagttaagaattttgcagaatctaagagtcacatctctaaatttgtgtagattgtgaaatctcttcttgcaagaaaaaagagaaatagctgaagttctggaaataacagttgatgaaaacttggtaatctgaagtctgaactttgaacaccagcagacaggctgagaattctctttgatcatgagcccaagttccacgtgtacctgcaggaatctgtgtggcatttgtgcactggtgtggggcccaggagaggaccacggagtgacaagccaccaggttctaaagggagacgaagatccccagaggacctggatagagatgtttccctgaccattgtctgctgtgtgctcccgatgatgagactctagagtttacaactgaaacacactgtcatttatgatattatttgtaatatctggtatgtctaagtaaaacatgcattcagtaaaactcgcgatgaaactta

SEQ ID NO: 119359 - DNA, 766 bp, Homo sapiens
  Payload ID: 3375
  Gene Symbol: C7orf34
  Gene Name: chromosome 7 open reading frame 34
  Uniprot ID: Q96L11
  ENST ID: ENST00000409607
  CDS Start-End: 42-485
ggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaacaa

SEQ ID NO: 119360 - DNA, 717 bp, Homo sapiens
  Payload ID: 3375
  Gene Symbol: C7orf34
  Gene Name: chromosome 7 open reading frame 34
  Uniprot ID: Q96L11
  ENST ID: ENST00000458732
  CDS Start-End: 1-460
aatgacccactgtggtcatcttggaagcctcggccatccctgctggctgtgctccattcttgtgcctcgccattggaacgctctagtgagccggaatgaagttcaggcccatggctgtgatgtcacagaacatgtgaagtcagaggtcctatggaaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaa

SEQ ID NO: 119361 - DNA, 763 bp, Homo sapiens
  Payload ID: 3375
  Gene Symbol: C7orf34
  Gene Name: chromosome 7 open reading frame 34
  ENST ID: ENST00000617608
  CDS Start-End: 42-485
ggagaaaatgcccctggaaagggttaagggccaggacaggaatggggcaggaggtgcacggatcctgctgggcactgggagcagggggcggccaaaggcagtgggtgggcaggtccatgcctcccctggccccccagctctgcagggcagtgttcctggttcctatcttgctgctgctgcaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggctctctgcctctgatcaccatcactgtatctcaaggttcagcagcagagataccagttgccatcagtgctaactgactgcctctccaggttcggagtttcatctcccagggccagagacagcagacccacatccttctctcccacacctctcctggttttgttcaggacagcagattagaggcaggaggcaatgacaataaaataacgataaaatcctgagaa

SEQ ID NO: 119362 - DNA, 717 bp, Homo sapiens; identical to SEQ ID NO: 119360
  Payload ID: 3375
  Gene Symbol: C7orf34
  Gene Name: chromosome 7 open reading frame 34
  ENST ID: ENST00000632848
  CDS Start-End: 2-460

SEQ ID NO: 119363 - DNA, 2520 bp, Homo sapiens
  Payload ID: 3376
  Gene Symbol: C7orf43
  Gene Name: chromosome 7 open reading frame 43
  Uniprot ID: Q8WVR3
  ENST ID: ENST00000316937
  CDS Start-End: 187-1929
ggttccggcgctgccgggtctcggttcgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacgctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaa

SEQ ID NO: 119364 - DNA, 1255 bp, Homo sapiens
  Payload ID: 3376
  Gene Symbol: C7orf43
  Gene Name: chromosome 7 open reading frame 43
  ENST ID: ENST00000394035
  CDS Start-End: 1-78
ctccaagacttccttgctgtgaggctcgtgtggaccccagagcatgcacaggctgtttactccacagagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaa

SEQ ID NO: 119365 - DNA, 2046 bp, Homo sapiens
  Payload ID: 3376
  Gene Symbol: C7orf43
  Gene Name: chromosome 7 open reading frame 43
  ENST ID: ENST00000456769
  CDS Start-End: 524-1459
tttctctccagtcattcggctcagtaccccggttccggcgctgccgggtctcggttcgggttcgttgccccggtgccgggaccgggccggtctctccggccgccccagccgggcgcagcagccggagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggaggg

SEQ ID NO: 119366 - DNA, 2005 bp, Homo sapiens
  Payload ID: 3376
  Gene Symbol: C7orf43
  Gene Name: chromosome 7 open reading frame 43
  ENST ID: ENST00000457641
  CDS Start-End: 479-1414
gatgaactgccggtcttaaagggaaaggctgcaggctgcctctgacttgctcctgacctcttcacccctttcccaaccccagctgcctgtggaggaaccgattgtgtccacagatgaggtcatcttcccactcaccgtttcactggatagactgcccccagggacacctaaggccaagattgtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaa

SEQ ID NO: 119367 - DNA, 2200 bp, Homo sapiens
  Payload ID: 3376
  Gene Symbol: C7orf43
  Gene Name: chromosome 7 open reading frame 43
  ENST ID: ENST00000419037
  CDS Start-End: 161-670
cgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccagggggaggggatcctgggggtgggggtttgttccgaggctgcagcccccttctcacccacggcccgggccctgctacctcagggggagcgaccacgctgcctgtggaggaaccgattgtgtccacagatgaggtcatcttcccactcaccgtttcactggatagactgcccccagggacacctaaggccaagtgagcacgctgctgactctgctgccccctccggttctgagatgccggcagttcactgtggctggaaaacacttgaccgtgctcaaggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggagggagaa

SEQ ID NO: 119368 - DNA, 1616 bp, Homo sapiens
  Payload ID: 3376
  Gene Symbol: C7orf43
  Gene Name: chromosome 7 open reading frame 43
  ENST ID: ENST00000448720
  CDS Start-End: 1-452
tacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctgagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggaggg

SEQ ID NO: 119369 - DNA, 1500 bp, Homo sapiens
  Payload ID: 3376
  Gene Symbol: C7orf43
  Gene Name: chromosome 7 open reading frame 43
  ENST ID: ENST00000419841
  CDS Start-End: 1-300
gtagtgactgtgtggaagcgggagattgaggcaccagaggtcagagatcaaggctacctgcgattgctgcagacccgatctcctggggagacattccggggcgagcagagcgctttcaaggcccaagtgagcacgctgctgactctgctgccccctccggttctgagatgccggcagttcactgtggctggaaaacacttgaccgtgctcaagggtaagcagggctgccggctccagcctccgggagcaacaagggaactgattggatgcagttcctctgggcaggctggtgggtgctgaacagctcctctcaggaggaaatctccatctgggatatccgaatcctccccaacttcaacgccagttatctacctgtcatgcccgatggctctgtgctgctggtggacaatgtctgtcaccagtctggggaagtctccatgggctccttctgccgcctacccgggacctctggctgcttcccctgcccgctgaatgccctggaggaacacaacttcctgtttcagctgagagggggtgagcagccccctccaggggccaaggagggcctggaagttcccctgattgctgtggttcagtggtctaccccaaagctgcccttcactcagagcatctacacccactaccgcctgcccagtgtccgcttggaccgcccgtgttttgtgatgaccgcttcttgtaagtcccctgttcggacctacgagcgtttcactgtcacctacacgctgcttaacaatctccaagacttccttgctgtgaggctcgtgtggaccccagagcatgcacaggctggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagccatcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggct

SEQ ID NO: 119370 - DNA, 1250 bp, Homo sapiens
  Payload ID: 3376
  Gene Symbol: C7orf43
  Gene Name: chromosome 7 open reading frame 43
  ENST ID: ENST00000612870
  CDS Start-End: 44-808
ctccaagacttccttgctgtgaggctcgtgtggaccccagagcatgcacaggctgtttactccacagagtggctttgagaatcagatgagactgtgctggcgaaggccctgtgggaatgaggaacgctgtagtgtttgctggtccctgtttctgcccccaggaaagcagctgtgtgaggaggagcgccgggccatgcaggctgccctggactccgtcgtctgccacacgcccctcaacaaccttggcttttcccggaagggcagcgcgctcaccttcagtgtggccttccaggctctgaggacggggctcttcgagctaagccagcacatgaaactgaagctgcagttcaccgccagcgtgtcccaccctccacccgaggcccggcccctctcccgcaagagcagccccagcagccctgctgtccgggacttggtggagaggcatcaggctagcctgggccgctcccagtccttctcccaccagcagccttcccgaagccacctcatgaggtcgggcagtgtgatggagcgcagagcctcacgccccctgtggcctctcctgttggccgccccctctacctgcccccggacaaggctgtgttgtctctggacaagattgccaagcgcgagtgcaaggtcctggtggtggaacccgtcaagtagcaccgtgccagctctgttccctcttacactccagagacccaacgcccccagaggggatccctgctcccgggctgtgcctcccctgggatgcctcccagacgggggtgaagaggcctggcagagctgcctgtcttgtgtctgctgatgagggatgggggaagaagctgtgaagtgggcgggcatggctgggactaagccaccagtattccccgagttcctgtggggggggctggccccacccctaggccagggcaagggttcccagagctcccttgtccccggccctttaccctggttctgagtttacaaagtctcttcctcattcccgttgagttctttcccacctctgacattccctccctccctcccgcagggctgagattagagggtggtgatggctaagggcccctgacagtgaccttcctgtctcaggggttggggacagggccaggtagcctcctgccccttatgtttacgtttgcagcctgaagcactttaatttttttttttttggtctgttcctgtaacttattttccaactattgcttccaactgaaataagactattaaatgcctgttcaggaggg

SEQ ID NO: 119371 - DNA, 1482 bp, Homo sapiens
  Payload ID: 3377
  Gene Symbol: C7orf49
  Gene Name: chromosome 7 open reading frame 49
  Uniprot ID: Q9BWK5
  ENST ID: ENST00000393114
  CDS Start-End: 183-656
cagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 119372 - DNA, 1579 bp, Homo sapiens
  Payload ID: 3377
  Gene Symbol: C7orf49
  Gene Name: chromosome 7 open reading frame 49
  ENST ID: ENST00000430372
  CDS Start-End: 327-797
ggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaaactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggt

SEQ ID NO: 119373 - DNA, 1738 bp, Homo sapiens
  Payload ID: 3377
  Gene Symbol: C7orf49
  Gene Name: chromosome 7 open reading frame 49
  Uniprot ID: Q9BWK5
  ENST ID: ENST00000424142
  CDS Start-End: 604-912
aaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 119374 - DNA, 596 bp, Homo sapiens
  Payload ID: 3377
  Gene Symbol: C7orf49
  Gene Name: chromosome 7 open reading frame 49
  Uniprot ID: Q9BWK5
  ENST ID: ENST00000483029
  CDS Start-End: 145-453
agacggcagggcttaaagttccgggaatcaaagatcaactcccactgaggacaaatggacctgtaattccgggtgtgacgagagaacgagatttaccttcctgaattaaaaaacagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacc

SEQ ID NO: 119375 - DNA, 1727 bp, Homo sapiens
  Payload ID: 3377
  Gene Symbol: C7orf49
  Gene Name: chromosome 7 open reading frame 49
  ENST ID: ENST00000617987
  CDS Start-End: 388-597
gcggccgctccagtcggaaggagccgttgcagccctgcccggcgtgtggcggggtcagcgaggcccctgcggtgcttcgcccgcgccttccgctccgcactcacccgccctctgggcctcccacaggtcggcgccgccagcggcgggtaccggcccgcagagggagggcgggctgtgaactggcagcacatcgcgttcccgcggggcccccattctgcccaggcagggagcggctgggatgggactgaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgt

SEQ ID NO: 119376 - DNA, 1349 bp, Homo sapiens
  Payload ID: 3377
  Gene Symbol: C7orf49
  Gene Name: chromosome 7 open reading frame 49
  Uniprot ID: Q9BWK5
  ENST ID: ENST00000620897
  CDS Start-End: 212-520
catagaagagtagagaaatcgagttggccagatgagggagaggccattaagaggaatcaaagatcaactcccactgaggacaaatggacctgtaattccgggtgtgacgagagaacgagatttaccttcctgaattaaaaaacaggtcattaagcttgggccctgactcttctttgtgagaagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgt

SEQ ID NO: 119377 - DNA, 1294 bp, Homo sapiens
  Payload ID: 3378
  Gene Symbol: C7orf50
  Gene Name: chromosome 7 open reading frame 50
  Uniprot ID: Q9BRJ6
  ENST ID: ENST00000357429
  CDS Start-End: 71-655
gccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagccgtgggtcctgctctgtg

SEQ ID NO: 119378 - DNA, 2131 bp, Homo sapiens
  Payload ID: 3378
  Gene Symbol: C7orf50
  Gene Name: chromosome 7 open reading frame 50
  Uniprot ID: Q9BRJ6
  ENST ID: ENST00000397098
  CDS Start-End: 928-1512
gcgacgcagctgttcacgcttaggtgggcgacgtgggcgcaggtgggcgcaggtaggcgcgtggggcggcggcggggtggccggcgggtcagggcgccaggagacccagagccccggggcgggctcccgcggggctccgccccctccacgtgggtgcgcggaggcccggcgcggcgcgaccgggcggcggccctggggtccgcggtgctggggaggctggtgcggccggtgcggccggtgcgtcccggcgcgggctccgacacccgcacccgcctctgggttaactcagcgcgggcgagtggaagggactcagctggctcctaggtttcaggccgtcagggcttgcagtggctctggtttcattgtctttctctgaagacgccctgattgccctccgaggctttcagctcccactttctctttttcaatttttgaggcagtgtctcgctgtgccacccaggctggagtgcaatggcgtgatcatagctcactgcagcctccacctcctgggctcaagccgtcctcccgcctcatcctcccaagtagctgggaccacatgcgcgcgccaccacacccggataatttttaaaaatgttttttgtagaaatggggtctcaccatgttacccaggctggtctcgaattcttgggctcaagcgatggatcctcctgcctcggcctcccaaagtgctgggattacaggagtgagccaacgcgcttggcctcactttccatcataagcatgctttccgtttccttccttccgtcattcattcattcatttttaaaaaacgttcattgggttcctcctgcactgttcggggcattgggctacagctgtcaacaagtggagacaagtctgtgatctagtgaacttccattctggaggggagagacagatgaacaaggtgcacagagcaggtgatggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagca

SEQ ID NO: 119379 - DNA, 1264 bp, Homo sapiens
  Payload ID: 3378
  Gene Symbol: C7orf50
  Gene Name: chromosome 7 open reading frame 50
  Uniprot ID: Q9BRJ6
  ENST ID: ENST00000397100
  CDS Start-End: 42-626
gccggaaggcggcgtccgcgacgcagctgttcacgcttaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagccgtgggtcctgctctgt

SEQ ID NO: 119380 - DNA, 507 bp, Homo sapiens
  Payload ID: 3378
  Gene Symbol: C7orf50
  Gene Name: chromosome 7 open reading frame 50
  ENST ID: ENST00000444428
  CDS Start-End: 1-489
gggccccaggatgcaagcacttgttttcctctgggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcg

SEQ ID NO: 119381 - DNA, 1147 bp, Homo sapiens
  Payload ID: 3378
  Gene Symbol: C7orf50
  Gene Name: chromosome 7 open reading frame 50
  ENST ID: ENST00000412051
  CDS Start-End: 1-538
cgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccga

SEQ ID NO: 119382 - DNA, 621 bp, Homo sapiens
  Payload ID: 3378
  Gene Symbol: C7orf50
  Gene Name: chromosome 7 open reading frame 50
  ENST ID: ENST00000491163
  CDS Start-End: 45-621
cctgccggaaggcggcgtccgcgacgcagctgttcacgcttaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgc

SEQ ID NO: 119383 - DNA, 1210 bp, Homo sapiens
  Payload ID: 3379
  Gene Symbol: C7orf55
  Gene Name: chromosome 7 open reading frame 55
  Uniprot ID: Q96HJ9
  ENST ID: ENST00000297534
  CDS Start-End: 254-595
caaacccttgttctgggttagaggtcctggtaccttcagttaacagtcgggtttcgtttgattttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaggtttttctctgtaattttgtttactagttcttaggggaattaactggacatttcatctttactctcagtgaatttactgaactttttgcactagactgatgttgtttttctacttaaaaaaatttttttatattttattttaaaagtagtacaagccttagccaggcacggtggctcacgcctgtaatcccagcactttgggaggccaaggcaggcggatcacctgaggttgggagttcgcgaccagcctgaccaacatggaaaaaccccgtctctactaaaaatacaaaattagccaggcgtggtggcacatgcctgtaatcccagctactcaggaggctgggacaggagaatcgcttgaacccgggaggtggaggttgcgatgagctgagatcgcgccatggcactcactccagcctgggcaacaagagcaaaactctgtctcaaaaaaaaaaaaaaaattagtataagccttttgtttaaggaattcaaatgttataaacataaaataaaagaaaccctc

SEQ ID NO: 119384 - DNA, 2125 bp, Homo sapiens
  Payload ID: 3380
  Gene Symbol: C7orf57
  Gene Name: chromosome 7 open reading frame 57
  Uniprot ID: Q8NEG2
  ENST ID: ENST00000348904
  CDS Start-End: 213-1100
gttccgcggcgcgctgggagtttgggtttggttggctgcagccagccagccgtgtaaaaactccaacgccgggcgccgcgggcagcacccacggagacccgcggggagctgctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtgcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagtcttctcaaagcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattaga

SEQ ID NO: 119385 - DNA, 1925 bp, Homo sapiens
  Payload ID: 3380
  Gene Symbol: C7orf57
  Gene Name: chromosome 7 open reading frame 57
  Uniprot ID: Q8NEG2
  ENST ID: ENST00000435376
  CDS Start-End: 432-893
gatgttgtggttccgcggcgcgctgggagtttgggtttggttggctgcagccagccagccgtgtaaaaactccaacgccgggcgccgcgggcagcacccacggagacccgcggggagctgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaa

SEQ ID NO: 119386 - DNA, 1957 bp, Homo sapiens
  Payload ID: 3380
  Gene Symbol: C7orf57
  Gene Name: chromosome 7 open reading frame 57
  ENST ID: ENST00000420324
  CDS Start-End: 2-976
gatgttgtggttccgcggcgcgctgggagtttgggtttggttggctgcagccagccagccgtgtaaaaactccaacgccgggcgccgcgggcagcacccacggagacccgcggggagctgcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagtcttctcaaagcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaa

SEQ ID NO: 119387 - DNA, 2056 bp, Homo sapiens
  Payload ID: 3380
  Gene Symbol: C7orf57
  Gene Name: chromosome 7 open reading frame 57
  ENST ID: ENST00000430738
  CDS Start-End: 2-1024
gatgttgtggttccgcggcgcgctgggagtttgggtttggttggctgcagccagccagccgtgtaaaaactccaacgccgggcgccgcgggcagcacccacggagacccgcggggagctgcgtgcagcgcctgaccatgaggaacacaagcaaggaacttcagggcgccacgcaccgctacgctccctgcgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtgcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagtcttctcaaagcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaa

SEQ ID NO: 119388 - DNA, 1927 bp, Homo sapiens
  Payload ID: 3380
  Gene Symbol: C7orf57
  Gene Name: chromosome 7 open reading frame 57
  ENST ID: ENST00000539619
  CDS Start-End: 432-905
gatgttgtggttccgcggcgcgctgggagtttgggtttggttggctgcagccagccagccgtgtaaaaactccaacgccgggcgccgcgggcagcacccacggagacccgcggggagctgattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaagctgaggctaccggccattgactcaaagtatctgagcaaagcaggcaccccacttggccctaagaatcctgcaggaagtagactctccttcccccccgtcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccagagtcttctcaaagcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaatt

SEQ ID NO: 119389 - DNA, 3981 bp, Homo sapiens
  Payload ID: 3381
  Gene Symbol: C7orf60
  Gene Name: chromosome 7 open reading frame 60
  Uniprot ID: Q1RMZ1
  ENST ID: ENST00000297145
  CDS Start-End: 167-1384
aatcagtttgcacttttgggtgagggtccacctccaaggctgtcgctccggttcctctgcctcctctggctgctgcctccgcagctccctcctcctaccccacctcctccatctggggagcgtctgcgggggcctgaggggcggcggcggcggcggcggctgcgatatggagccaggggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaagtgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttccttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgttgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaaccaactttgatagggtcctcacctttccgttaaggaggtgccgcactacaagtttcaaattatatggaaaaacctaaaattaaccctctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaattaatgaaagtaacaagattgtaattttttaaagtcagttgattaaatgcaataaatattggttgctcaaatatgccacaaataactcgaaatttttcatttactttcaacagcataagattctttaatatttaggattgactgttctttccagttaagcactgaaggattatgtcttgtagcttccccaagagaaggggaaggaaaaaaaagcactatgttaaggataatacagaactcttttgaactattttggtagtaccttttaccatactgtttgctttttgatttgggtaaatatcttaagagcaaagaaaacaatacaccaaatgaaaatgctttgaaagtaaatgaaaacagcgcttttgaaaggctggtatagtatgaccctggagtcagcctttgtgttacagcgaaaatgttggtgctataaattctgattgtttacagatgttgattctgcttatgctccaaagtgtgcatgatgtattttacgtagtactctgaggaagtctctttataaaacctactaccacttagtataaatttgtttgaatttatatcatttgttactgtaaattcagcttattccaattaggttggcacagatttaaactgatacacattccacaaaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagta

SEQ ID NO: 119390 - DNA, 1271 bp, Homo sapiens
  Payload ID: 3381
  Gene Symbol: C7orf60
  Gene Name: chromosome 7 open reading frame 60
  ENST ID: ENST00000432572
  CDS Start-End: 1-1164
cggcggctccgcaagaagtaccgagaagtgggctttaaacacagctgctttaaaattttgaccaagtccaagaccttaagaaactttgaacagattcttttctcaatgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaaga

SEQ ID NO: 119391 - DNA, 1004 bp, Homo sapiens
  Payload ID: 3382
  Gene Symbol: C7orf61
  Gene Name: chromosome 7 open reading frame 61
  Uniprot ID: Q8IZ16
  ENST ID: ENST00000332375
  CDS Start-End: 247-867
gtaggttctcacctacttcgactcctctccctgtcccagggaggggagaaaaggtctgggattcattgccaggaggggcttcccccaggatttcctacttctttctttactgctgtgcttgaagctcacaggagacccctcaagaggtggtcaccggcccacagcccaccccatcccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctctagggggaaccccagacccttagagagtcctgacctcactcttacctggggtcccatatcagccccttcattccatgtattccagttgtaaaacaagtatcaaaatattgggaaataaatatcagatagttctgagtcag

SEQ ID NO: 119392 - DNA, 573 bp, Homo sapiens
  Payload ID: 3382
  Gene Symbol: C7orf61
  Gene Name: chromosome 7 open reading frame 61
  ENST ID: ENST00000418952
  CDS Start-End: 1-573
cctggcctgtggccaaacaagatggagtggggaggaaggaaaggacagctggggaggggctggaggagaaggaagagaggccaggaaactcactgctccatcccttttgtgccttcttttctgtggatggtgttgtctctgccctgcccctctctcctgtctctcctctctgtgtcttggttctcaggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactcc

SEQ ID NO: 119393 - DNA, 1023 bp, Homo sapiens
  Payload ID: 3383
  Gene Symbol: C7orf62
  Gene Name: chromosome 7 open reading frame 62
  Uniprot ID: Q8TBZ9
  ENST ID: ENST00000297203
  CDS Start-End: 187-948
tggcagttgggagcctgatggaggacaagtagggcctcgaggacaggtgcgtgacagaagcacaggaaaaaaaagaaaaatgaagaaataaaaacacgagttcatcagtaaagaggtaccctggcagcataaatattatgataagctaaaagctggaatcatctggaaaaataaataagactcctcatgtccttttcggtccataaccagaagggcagcaaaaggcctttgccactggaacctcttctttttctccaagtcccacgtagcaattacctgcactttcaagaagagaaacaacgactacacctaaagaaattccttcttgataggatgtttctagtggccaagatacaagcaaatgtagaaagaaaagatgttgctgactactatgaacaaatgtttcagtcagttttgaaacatcacctaggagaagcagtgacaggattgctgctcatctatcccacttccattctgcatatcctcgagtcctccagcgacactctctacaaagttcttttagattatattggccatgtcaaagatgaaacagtattttttattcaacaaatgaaaattatagtcatttctcataacattccaatgaggctttttatgcaatggcatgtttcagtgataaaagttccagttatgtatctcgacgatgtgacacagtcacagtccctaaaggaggtcatcacagattttctcacacaaactcataaactgtcactctacctttgccagactatgaaagtaggcactaaaggaccaggcgataacttacaccaagttgcacctgacctactcctcccagaacaaatcataaagtacttgtgcaaatccgaagaattcatggacccggcaacatttataaacatgtataatagacccatacacatcactctggattctgaggtggtatggcctgctccttcacgtttctaggattgagagggataatgtgcccatgtctcttaaggagtttgtgctacttaaataaaaaaaacatttttaaagtta

SEQ ID NO: 119394 - DNA, 2028 bp, Homo sapiens
  Payload ID: 3384
  Gene Symbol: C7orf72
  Gene Name: chromosome 7 open reading frame 72
  Uniprot ID: A4D263
  ENST ID: ENST00000297001
  CDS Start-End: 51-1367
gaattatcagaaatactttatagttatcaaaaattctaaagaaaaaggccatggatgtagaaattcaggacacacctggaaagataagtatctctaaaaggtccatcctttcaggaactgttgagaatatagattacccacactattgtgatctcttaagaaaaatgaacatgccttttgtgaaaggtcttgagaacagacataactatggcaggtttgaaaagaaatgcaaccctgcttttcttaaatttcacccttatcccccttcagttttgccagactatcatttacatgatccttatcccccaccatatgggccacattatccattatttccacttcgggatgatgtgaccttaggtgattcctgttcagggtttatgagtcctggtggtgatgctgatttaaatcctggcattggcagaaccataccaaccctagtggattttagtgatgtgaaacctcaacatcgagttcccagaccagacacaggatttcaaacaacaataaaaaggcaaaaaattctatcagaagaactgcaacagaacaggagatggaattccagggaagtaccagacatttctatcagagcaagacttggaggttggacaagccctctgaaagttactcccttacaacctcatcatgaaggacgctcattaagtcacatatttacatttgatgaggaggcaacatgtacagatgaaggtgaaccacttgttcaaacaaacaagaaatgtaatgcaaaggactcattttacaagtcctctacacaaaaagcttatgaagatgttccttgggataagatgctaccaccaaaacttgttccagaagaaacaacattggaaaaaaccgctgaccccatctcacagtgttttactctgaaaagatataaaggggtgccagcaataactcagatggttggtgagctctgggacagatttcaaacaagatctttcttggcaccagtcaaaccaattaattttgtgagttcaagttctagaagtaaatatattcctctctatactggtcatgtgcagtctacaaatgctgatgatgttgacaaccccttgggagacatcgcatcgctagccaagcagcggtactctaagcctctttatacaaacacaagtcgtgctgcaaatattccaggatataccggcaaggttcatttcacagccacccacccagcaaattctaatattccatcaacaaccccatcaccagattcagaactgcaccgcgtcttccagaaagaaatggcagttgacctcttccgtcaccaggctcccctgtctcgactggtcacaactgtgagaccctacaaccctttcaacaagaaggacaaagaaaccatagactactagaggaggcggccctgcgcgggctgtccaggcctccgcctggggaaggcttgtgcggcggtgggaaataaaggctgcttctccgcgctgcgcagtgtggtgggttcggtgctgttctccgctggcctgcgcgtccctgcccagcccgcctctctcccccggcaggcggcgctcagctggacactgggcgcccgccagccgcggcgcagactcccaagccgccggcagcagggtagcagggcctgtgttgcagaagattcctctttagggttggaatattgggtctacctagaggtttcacatggcaccacttcagtgcagggattctagagcagagagcagaccatagattttagaatctcaaaggcagtctagtcaaaaatccgtatgctgtcagtgggaaccctgagctactgagaaagtgcgttcttcttttctagcaggggacatcacacaaggggacaacatctaccctctcttggcctgctccagtgtttccttcagagagaagtgttccccagtccccatgagggtcctgaagtctaagtcaggaccactttgggttagagtgtggcctgacccggccttgaccaaagagagcaccagctcgcagaatctctcaggggtgcatgtgggctgagggggagccctctggccttcggaa

SEQ ID NO: 119395 - DNA, 2450 bp, Homo sapiens
  Payload ID: 3385
  Gene Symbol: C7orf73
  Gene Name: chromosome 7 open reading frame 73
  Uniprot ID: E0CX11
  ENST ID: ENST00000507606
  CDS Start-End: 60-203
gaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagttttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatcatgggcaagtggcttttttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccagcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagta

SEQ ID NO: 119396 - DNA, 581 bp, Homo sapiens
  Payload ID: 3385
  Gene Symbol: C7orf73
  Gene Name: chromosome 7 open reading frame 73
  ENST ID: ENST00000509448
  CDS Start-End: 85-222
ccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatgggatagggtctccctctgtctcccaggctggagtgcaatggtgggatcttggctcactgcagctttgaactcctgggctcaagcgatcctctcacttcaacctcctgagtagctgggactacagggcttcttcgctggaatgaggaagaggaggaagccaaggaagacagagactgtggcatcagtacggtagcctttcctagtaaagagacaagcatagctgaggagaagggtcaggaattttcaggagtaacatgatgtctcggagcagtctgtccgaacacagtgcctctttttaggacttatctagaggtaacattaagcttagttcttgccagttgctgccacgctatccactttggatttaatgggcaatggcgaatgtctggaggcagggcctggctagagtagatgtcttaatgtgaat

SEQ ID NO: 119397 - DNA, 548 bp, Homo sapiens
  Payload ID: 3386
  Gene Symbol: C7orf77
  Gene Name: chromosome 7 open reading frame 77
  Uniprot ID: A4D0Y5
  ENST ID: ENST00000616258
  CDS Start-End: 66-338
agcaggcagaaatccgcttctgagagagggcttcctgagagtgatggtgaaagttactggaagtaatgggagcagaaagggtttgtaccaaggctcctgaaatcacgcaggatgaagcagaaatctactctttgacaaacatggagggcaatattggaatcaaaggatgtgagttcaagtcttggctcttcaaattctatcaggctcgctctcaagttcttttgtgcggtgaagtcaagaatccgtacctgctcaccagcaacaaaaccacagtgaaggagcagaatgcctgtctgactcaccctgacagatcagctatggcaggtctgctgttgtagaaaattcttcaccccagaggctttatctctcctgcagggaaggctcatgagcaaatgctgtcattagcaaccatgcattgttgaagacatatagtgagaaaatatgtcaggtattgtttcaatgtaccaatgttagtagaaaatcctgaagaattttcgagatattaactgtagattaaaacaacctttaacctaaatcctgagaatttc

SEQ ID NO: 119398 - DNA, 1499 bp, Homo sapiens
  Payload ID: 3387
  Gene Symbol: C8orf22
  Gene Name: chromosome 8 open reading frame 22
  Uniprot ID: Q8WWR9
  ENST ID: ENST00000303202
  CDS Start-End: 174-428
cactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactgggtcgctgtcaggaagatcatagcaccctttccagttcaatcactcaagagtggtggagaagtcatatgccaaactgtgtcattgtttggcgggggatggactgagaatcagaggaaagggtctaaatttgttttgctcataccttcaggaaaagaataaccattgtctagttgttgtcttaaataaccttaggataacactgctgattttgattagcttctgtgtggtgcaaattactagacaggttgaattgggagtttgtgtgcagttgttttcagacattttgaactcaaacacactgactagcacagttgtaatttaatatatttaaactacttattttggattttagacatttgaatgcctagtaactaaatggaatagaaagaatctataataaagggattcatagatgccaatgttgaaatatagtgattctgatgaatttcctatctaagacaaatttagaatcattatttaaaattagaatcattatttaaagtatttttaaaagccaatgcaagattgattgttggaaagatgttttcttgacactctttatcaagtttattcatttgaattatctggacagtgtttcatttatttatcccctcctctctgactactataaaatcaacccagattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactctt

SEQ ID NO: 119399 - DNA, 1272 bp, Homo sapiens
  Payload ID: 3387
  Gene Symbol: C8orf22
  Gene Name: chromosome 8 open reading frame 22
  Uniprot ID: Q8WWR9
  ENST ID: ENST00000399653
  CDS Start-End: 184-429
acggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactctttttctgtctgttgagtgatttatttattatgccttaaaactgacttgtcaatgtttcacataatggtttaaagggcattgaattcgaaattttagaaaataattgtaaaaattcaatttttttaaaagaatgaaggttggaaatagcatatgtatcattaagtatattagagctaatcaattggtcattgtatagactttaaaatttatgactttaaataatatttaataacatggaaaattatattatggcattaaaaattagcataatacaccatatatggtacaatcgtagttgtattaaaaagttacatatgcataaagatagactggaaggaactgtaccaaaatgctgacagggctatttctggagatgggattatgggcgtttttcattctctttttaatatatttttccatatctcccaatttttctaatatgacaagtattgtgcgtaattagaaaataataaatgttaatataaaaaa

SEQ ID NO: 119400 - DNA, 739 bp, Homo sapiens
  Payload ID: 3387
  Gene Symbol: C8orf22
  Gene Name: chromosome 8 open reading frame 22
  Uniprot ID: Q8WWR9
  ENST ID: ENST00000522267
  CDS Start-End: 187-441
atcacggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgca

SEQ ID NO: 119401 - DNA, 788 bp, Homo sapiens
  Payload ID: 3387
  Gene Symbol: C8orf22
  Gene Name: chromosome 8 open reading frame 22
  Uniprot ID: Q8WWR9
  ENST ID: ENST00000517663
  CDS Start-End: 104-358
cagtgtgaagaagaggaagatgaagacctttctgatgattcacttctacttaaggcataattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacagaaatgtgtctgagatctcatttatgagacaagatcacagcagccactgatataaaaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattttttatatcatttttattaaaaaaacttaagttagactcttt

SEQ ID NO: 119402 - DNA, 2677 bp, Homo sapiens
  Payload ID: 3388
  Gene Symbol: C8orf33
  Gene Name: chromosome 8 open reading frame 33
  Uniprot ID: Q9H7E9
  ENST ID: ENST00000331434
  CDS Start-End: 115-804
ccgcccgcgccccgcccgcgccccgcggaacctagagtcgcaggcgcgttcttgaaggacggaattcggcgtcggactctgcgccccgcgtagttccggtggcgactgcggcgcatggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcccggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttctttta

SEQ ID NO: 119403 - DNA, 2281 bp, Homo sapiens
  Payload ID: 3389
  Gene Symbol: C8orf34
  Gene Name: chromosome 8 open reading frame 34
  Uniprot ID: Q49A92
  ENST ID: ENST00000325233
  CDS Start-End: 119-724
aagaaaatgaaacagaattgaaaatggtcttgtaaaattccacttggggtggcgatgctttgtggcttgaagtgtaagggatgagaacagcatgtgaattccaagaaagcaacacagaatggaaaatggatttacaatgtgtcagacagggaggcaacatcctgtggcatgtggcttgcatctcagcggtgggaaagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataagtttgaatataaaatgtgagtctggagaaaaaggaaggctaaaatttgaagaaatatacatggagaagacatgcaagacagtgtattagtcggttttcacactgctataaagaactgcctgagactgggtaattgtaaagaaaaaaggtttaattgactcacagttccccatgtctggggaggcctcaggaaacttacagtcatggcagaaggaaaaggagaagcaagcactttcttctaaggagagagagagagcagtgaaagccacacatttttaaaccatcagctctcgtgagaactcattatcaagagaacaacaagggggatatctgcccccatgatccaactacctcccaccaggcccctcttctgacacatggggattacaatttgacatgagatttgggtggggacactgagccaaataatatcagacaggtcctccagactgtgggttcaatgcttacaaaatcaaaacacaaaacatttagaatcaatttagccagtaccctctaattacattttagatttttaaaaacacaaataaataagctaaaaacacacaagcaaacaaacaaccaaaccaaaccaaaccaacaaaacaacacaaatgtcccaaataaagaaataatagccaaagtcacagatgaaagctaatgctgtcataaaacattaagacttccccacttgggtttgggtcctagttcttcctgaggtcttaatgtctgtaacaataggtaatttggccctgggtctccttaaggcagggagattgagatgatgacacggtatagagcctgtcacctgcaaggactgactcaggtataaaaagggaaataaaatacctgtactctctaactgtggaacaagccatgaaatttgctattggtattagactttgaacgaaaaatgtaaagatacacatagggaatcaaactctcagctctgtactttggttattcggttcaaacttaaactatctgtattgtcagaaaccccacattataataacaattggccagcttcattaaaattcacagggtcctctcatgtgtaaatgtaagaactggggcatttagaactcccaaagatttaaatatcaactcctgctgaagacgagctctcaatcaaattacaagctgcctgaaaagttatagtaaaacaacagagtcagcaaatgctaaaaacactagaattagaatgatgagaaaggaaagaaataagacaatcagaaagagaccatattaaaagtatgcttaagatatttaaagatatagatcaggcgcaatggctcacgtctgtaatcccagcactttcggaggccaaggcgggcagatcacgaggtcaggagatcgagaccatcctggctaacacggtgaaacgccgtctctactaaaaatacaaaaaattagtcgggcgtggtggcacacgcctgtaatcccagctactcgggaggctgaggcaggagaatcgtttgaacccgggaggtggaggttgcagtgagccgagatcacaccactgcactccagcctgggtgacagagtgagactccatctc

SEQ ID NO: 119404 - DNA, 3652 bp, Homo sapiens
  Payload ID: 3389
  Gene Symbol: C8orf34
  Gene Name: chromosome 8 open reading frame 34
  Uniprot ID: Q49A92
  ENST ID: ENST00000337103
  CDS Start-End: 1593-2876
gcccaggtaaagccatgttttcctacacttaaaaatgtaaataaatatcccttagataatctggacagcagtttcttatatagcatgtctgagcactatattttgctgggctataaaaggtttaattgttgtttattggtacaataagggattctagttactaatatctacctgtagtcaataaagcaaacattgattggttgatcgaatcattgattcattcaataggtattgattcagcaccagctatgagctaggcagagttctaggccctacagagaaaactgatatcaaactaagaaagtctttttccaagtgctacagtaggggtgggggaggagagagataacaaactggtgagcaaatgttaaacaaaatgattctagagagtgctaaatactgtgaggaagataaaatgataaaataataaagacttctgaagattggttagggtaacctcttgtagaagtatcattggagaccgaaggatgacacaccagccatctgaccatgagagaacatcattcaaggcaaaggaaacagaccaccaccaacaaaaaaagatgcactggggaatttccagtaacacttttgttagctctcttaatatctgattttttgagcactagaacactgcctctcacagaatcctagcttaaaacagcaatgaacagactagaattctaggctaaaaccaacaagatgaaatgtgactgatatgaatataaatggtgcacataagttcacaaacccaattacacagcacaaaatgatatccacgtggcttgacagctgttcatattagaaaaatctagggattctaatggactacatattggagattgctctttgctgttcctgactggaaaaaaaaatatgtagatattacccttgggcagatttcagcccaacttaaagtatcattagagctgtccaaaatggaacagcctgctttgcacatagagaactcacattgctcaactcaaaaaagagcagaaggaaggaagaaggaaggacacgtaacagggatttttacaaaaacagaattcggtatttcttggagactactttaagacagtttttggtttctgtaagtctgtgacttattacttgttcctttaattccaataaaattttcttcatttttgttatttttaaaacattaagaagaaaaaaatgatattgatataaggtagatggtgaagtttagcaaaagtttagtttataatgatatctctcaaaatagcaaactgaagtttaaaattcttaagctataattttaaaggaatttagattaaacttttaatatgttgttggctaagtataatacaaaataaaaactaaataaatcttggttttgccacatattagctgtgtaatatagacaatttacttctctgttattgtttcctcagaatgagggcagtaacttgtagccgtctgaaaagattgttataagcatggagttagttgctgtatataaagcagttagaccagtacctgacaatattacatgctaagtaagtgcttgctattactgttgctgttattattaattataattgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 119405 - DNA, 3571 bp, Homo sapiens
  Payload ID: 3389
  Gene Symbol: C8orf34
  Gene Name: chromosome 8 open reading frame 34
  ENST ID: ENST00000348340
  CDS Start-End: 47-910
gccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctgggtaattttaaaaattaataatttctcattttcttctttgacattgtaaaaaaaacgtgtggtgattaagagattttaaaagttttgaatagccttgtcttagggaaaagaaaccatttagtacatattttatttacattagactcacataaagttgcatgtaagaactaaattgaaataccctaagcatatgaatatttattagactgtattttgtgctttgtgtatgctgcactttaccttctgactacgtaatgaagcgttattctgtgtgcaactgtgatcaaaattcaagtctgtctgctttattctctgataataattgccttgtttacatctattgtctataaaatatacccaaagtacatatttcagccctcactccaaaatgtctaccttttattttgaggatgctttagaaaaatagaataaagttgaaaggggcagatagtaaattcaggttttatgttttccgtaaatgacgggaaagtttgcagagatttcaaagtttcttcaggcctgttactttcatgaaaccttattaatcttgtatatgtaggatatctttttatattttttaatgtagtatatgtatgtttttgcttcatcagaaatctcttcatataaatttttaaactgaacttctctttggaacatcatttttctgaagaaagaaaatgaaatgttatttcagagtgatccacatataaaacaatgagttttgaagtcagtggtatcaattattctgctacaaataaagagtatgattttcaaatactttataacaatatgctgttgtattttatttagaaagagaataaataatataattatttgaaagccttaaacacgttttacatatagaatatggaatctcagaaaaatataggccattttctgaagtttttgttaaaaatgagattccttggttttaagtgtttatggcagtaaaatactatcattataaaaaatgatatattgcttatcatttttgcataggcctacaaaggtgttatttggtcaatggtgacaggtttgaaagatgttttctgatgctgtaaaaactgcattcatgctaacattaaggagattgtatcatggcgttttcattacatgctgttggtcccttccaattgggtcttttcctcacctccaaatcattaacatggcagacgtgccctatgtggcagtggtagcttcattcaacaaacatttactgagcacttactctatgctaagcacttggctggggtctgggaacataaaaataaaatcattgtgatctgtgtttgaaggaattttacattgtaatgttcaagatacaatacgtcactacctgtgctaactgcgctaattggatgaagcacacagttgtgtataggggtaacacctaaagcagaggtaagggacagtgacccaggaatgtttcctagagaagccgattactctggctagtcctgaaaagcaaatagatgtaagctcagcaggtggggtgtggtcattgtaggtttgctcacgtaggtatgggctgttttgcgattgtgctccataactatacctgtaaatggttcctctgctttggacagtaacagggaaggggcaactgagatccagggtttctttcaggagatgcagttgtccactccatgctggtactccctagatctcagctgccctgactgaaggttctagtctcccaagctgaagaccgaggattgagtcttggagactatctaatgatgagcaattaataactagtcctcattaattctttttttagacattttagcctgtggtctgagcaagtttaataataagagatagttgaaggtttggactttcttcatgtaattccacatatctcagcacaggtggcaagcagtgtaataatgttggtctctaggtcatgagattatcctcttatagcttggaatgttacaagtccactggactttatcttaaaataatgccatattcaatttcttgtttttgaaatggattccagcaaaatgtatgtgattgtgtctatttcagaaaaatataaatgctaagttcttggaaatttatgtgaaatctaattttatagagtttatatagaatcattgtaagatgcaatagagacatctggtatttaaaatctttttgaatctacattttgtagatgtgtgtgctatagcttatgtgtttgtaaatgtttaacttgtctttgttatctataccaagatataactggctgaaaaatatttattatgcatggaaagcactctgtaaaccttgtgaagtgataaataagtgaaaggtataattgttagttgacattaatataaaaaaggattattcttcaataaaattggttgatttgaagggaaaaaatccttttagttgaactagtagaagttagtaataactattgactcttgttttgtttattaaggaaactagcattgttaatatatactgattaatatttaattattcacagttgtttaattatatatttgtggatttcttttctaaatgttttaggcatatgaaaatattatagtacaacacctgtaatttttaagtagatcaaatattttctgtaagattgctttaaatgctccttataaattcacattgcaaaagtaacttaatatggaattaacacttgtcagataataaaacagccaaacttgt

SEQ ID NO: 119406 - DNA, 2223 bp, Homo sapiens
  Payload ID: 3389
  Gene Symbol: C8orf34
  Gene Name: chromosome 8 open reading frame 34
  Uniprot ID: Q49A92
  ENST ID: ENST00000518698
  CDS Start-End: 292-1908
agcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataa

SEQ ID NO: 119407 - DNA, 1428 bp, Homo sapiens
  Payload ID: 3389
  Gene Symbol: C8orf34
  Gene Name: chromosome 8 open reading frame 34
  ENST ID: ENST00000521406
  CDS Start-End: 30-650
tgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagtttagaagacacgtaatgcaatgatgcagaggacagatgccatggcaagagactgaagctaaataaacttcttccttccattttcaacttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtcc

SEQ ID NO: 119408 - DNA, 1948 bp, Homo sapiens
  Payload ID: 3389
  Gene Symbol: C8orf34
  Gene Name: chromosome 8 open reading frame 34
  Uniprot ID: Q49A92
  ENST ID: ENST00000523686
  CDS Start-End: 50-439
acagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcatgtaaggaagtctcttattcaaatgctattcaaagcatgtaagtttatgttgttaagaaaatgaagaaaaggtattaattgaagcccaacttttcatctgatatttctggcctttaatcttagtgaatttcacttttactccgcatttacattgatcttcattcatacgtatgtatttgcttgcttatattctcaaacatgtgtaattcacttggacccttttgagtataatattccttgaagaatataaactgcatggagcgggtctcttgtttctcatagccaattgtagcattacatcatattgaaagcagtagctacctatatttaatgaagtatgtaaaagcaaattaaatctcttagaatagaagcaaagaagatttctattcaaaacatttcataaaatttcttaaaaaatatttcatctgggattttcctgaagtcctactcattaatttgtgatggaagtccctatattctcttcactactactgtaatatctttgtttttatgttactacaaaggaatgactgaggttgggtattttataaagaaaaaaggtttatttggcttacggttctgcagactgtacaagaagcatgacactagcatctgcttcttgtgagagccgcaggaagcttccactcatggcagaaggtgaaggggtgcacgcatcatatggcgagaggaaggagaaagagatagcagagggaggtgccaggctctttttaacagtcagatcttgtaagaaccaacagagtgagaagtcactccttaccatgaggacagcaccaagccactcatgagggattgacccccataacccaaataccttccaccaggccccacctccgatattggtgatcaaatttaccatgtgatttggagaggacaaatatccaagctataccacctaagtatcccttctctctcaatggcctactgctttggtagctactgggattctccagtgctctgctatccccacatatgtataaacatgtcaaaaatctcaggagcctctagcaaatcacagctattcttggaagaaaagagaacttgcaagctgttcttcttatacatcaattccttgtgcttgttacagggtgagatgtttgattttagtttcaacagagaaaggagtaggcagaaaatatttatctttgtttgaaaatgtttgaaaaaccactatgtgctaactggaatctgcatctgggtcatttgtgaaagcaactaaatttaactttgtgagcagcttcatttacatagtggtactcataaaaagtattgcattaaccacaccaagttcttgtgagaattatatgaagtgttaacaacttaaaatgttcttcagaaattgtgattgtaaccaaattgtcctgcttcatcagtttggtatatagaattaggtcccaacattttaaaaaatatacaagtttaaaatttgcatgtcttttttacaacagtatagccagtaatatccagcacagtgcctgtttcaattaataaatgctaaatgataaaaatgaataaaggaagaaataaaaaatg

SEQ ID NO: 119409 - DNA, 3334 bp, Homo sapiens
  Payload ID: 3390
  Gene Symbol: C8orf37
  Gene Name: chromosome 8 open reading frame 37
  Uniprot ID: Q96NL8
  ENST ID: ENST00000286688
  CDS Start-End: 13-636
aggcgattcaagatggcggaggacctggacgagctcttggatgaagtcgagtccaagttttgcacacctgaccttctaagacggggtatggtcgagcagcccaaaggctgcggcggcggcacccacagtagcgaccggaaccaagccaaggcgaaagagacgctcagatcaacagaaacatttaaaaaagaagatgatcttgacagtcttattaatgaaatacttgaagagcccaacttggacaaaaaaccctctaaattaaaatctaaatcttcaggtaacacatctgtcagagcttccattgaaggccttggtaaaagttgcagtccggtgtaccttggtggaagctctattccatgtgggattggaacaaatatttcatggagagcatgtgaccatctgcgttgtatagcctgtgatttcttggtagtcagctatgatgactatatgtgggacaaatcgtgtgattatctgtttttcaggaacaacatgccagaatttcacaaattaaaagcaaagttgataaagaagaaaggaacacgggcatatgcctgccagtgtagctggagaactattgaagaagtgactgaccttcagacagatcatcagcttcgctgggtttgtggtaaacattaagaatgcagactgcacattcggacagatgcatccatgagagtggtctccatgaatcatcatcatgtttagacaatagtccctagcaataccattccctgtgggaaaaggcagtgaattttattgatacaactacatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatttttccctcttttgttcatttaactatcaaaagttattttctattttgattacccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtactatatagttcaaatgtgtgatacagagcaccctgaaagggaataattgaaacaaagttataatcttcttagtcttatgctaaatttattccagccaccctactgaagggaggaagatctgatcattagaatccttttcctagccatgacacatttacatacttgtaaaatttattgtagtaagtctagcattgcaacagaatagatcttataatggccaatcctcacacttttgtattaaggatattatgacagactaagcatggtagctcacgcctgtaatcccagcactttgggaggctgaggcaggcagatcagctgaggtcaggagttcaagaccagcctggccaacatgataaaacaccatctctactaaaaatacaaaaattagctgggcgcggtggtgcatgcctgtaatcccaactactcgggaggccgaggcaggaaaatttattgaacctgggaggcagaggttgtagtgagccaaggtcgcgccactgcgctccagcctggacaacacagtgagactctgtctcaaaaaaaaaaaaaagacattatgacagattttatcttttaataaaaatgtattatatccctaaagttatatctatatgtaattgagtcagaaacctagggggatgtcgattgaagtcgactgctggaaaaaaatagcagagcaacaagatccacacatttagaacctcatagaatttgacacattattcataatggtgcaattctttcttttttattccagtaagcaaatttactaaatcactaatttgaaaaaaaaaattttttttttgagatggagtgtcactctgttgccgggctggagtgcagtggcacgatctctgctcactgcaacctccgcctcgcagcttcaagtgattgtcctgcctcagcctccccagtagctgggattacaggcacacaccaccacgcccagctaatttttgtatttttaatagagacagggtttcaccatgttggccagaatgatgtcgatctcctgaactcgtgatccgcccgcctcagcctcccaaagtagcctacattgcctctactttgaagggacaaagttgtcctggtttttttttcccttttattatttcattataactatcctaaaacttacatacattgcctatgtttggcattccataacataataattataataatcccccaatgtcagaaatgtatgtgtgagttcccatgtttattggcaatttataagctttttaatattgtactattttaaactaaaatgtagaaagaatattatgtttatatacagtcagataaattattaactgttgtaatttaagctgaaaatgaaactattttagtatcagtatagaagaaaagtatagtttctaatcatctataattttaaaatgcaaagcctataaaactttcaagatgttttgcctgtttgtttttaagatttataataattttctatctttagcaagtagctatttttaagccaggtaacttctttatttgaactgtattatactctcagaccctcatcctgcctagaaatgaataagtaataaataattactctgtattatttacttcttttattttatagtaaaatattcatttggatgga

SEQ ID NO: 119410 - DNA, 1854 bp, Homo sapiens
  Payload ID: 3391
  Gene Symbol: C8orf4
  Gene Name: chromosome 8 open reading frame 4
  Uniprot ID: Q9NR00
  ENST ID: ENST00000315792
  CDS Start-End: 79-399
aaatagcagtcccagaatgatttcactacagactctctggaaagcctgggagctgaattccggaagatccccacatcgatgaaagcaaagcgaagccaccaagccgtcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctaggacagca

SEQ ID NO: 119411 - DNA, 1817 bp, Homo sapiens
  Payload ID: 3392
  Gene Symbol: C8orf44
  Gene Name: chromosome 8 open reading frame 44
  Uniprot ID: Q96CB5
  ENST ID: ENST00000390159
  CDS Start-End: 292-771
aaaaatcagaataagaagtacctgacatactttctacatctgtagttgcggaagacattttaataggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcaacatagtgagaccttgtctctactgaaaacaaact

SEQ ID NO: 119412 - DNA, 1835 bp, Homo sapiens
  Payload ID: 3392
  Gene Symbol: C8orf44
  Gene Name: chromosome 8 open reading frame 44
  Uniprot ID: Q96CB5
  ENST ID: ENST00000519561
  CDS Start-End: 152-631
ttatggcagtgggagtcgaagcgagggtctgaagttcacgactactagaaggggaggggagtggaaaggctctcagtgaaaaaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcaacatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaaaaaagaaaagaaa

SEQ ID NO: 119413 - DNA, 598 bp, Homo sapiens
  Payload ID: 3392
  Gene Symbol: C8orf44
  Gene Name: chromosome 8 open reading frame 44
  ENST ID: ENST00000521889
  CDS Start-End: 276-533
ttcacgactactagaaggggaggggagtggaaaggctctcagtgaaaaaggtcttctcatagcctttctttgctaaggacattgtgactctccagagagcaacagtgatggctctagaatgtctaggaaaaagaagggcttaatgtcaggagtctgcttggggcacacaacactagaagatgtccttctgcacattgtttcatatcgagtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtcatactttaaggagcccaagagctttataacataacaaaagaaactgaaatgtctaataaatgtgtacataacaa

SEQ ID NO: 119414 - DNA, 3513 bp, Homo sapiens
  Payload ID: 3393
  Gene Symbol: C8orf46
  Gene Name: chromosome 8 open reading frame 46
  Uniprot ID: Q8TAG6
  ENST ID: ENST00000305454
  CDS Start-End: 442-1065
atttctgaaatgagaaagggaattgctggtaccaaaattcacgtttcctttttggtggaaattctccagccaagcttggcgctaacagagtaggcgatttcacttcgtcgtcacctcacaaaaggcttccaaattcactgcggcagacaccgcaaaataaaaatgttaaatacatcctagctgggaggggattgaagcctccaggctcaatcaaaggtttgcaataataggattcatttaaaaaaaaaaaaaaaaaaaaggacagatgggtttagaaaatgttgcagtgaagactggaacgagatgagctcatagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataa

SEQ ID NO: 119415 - DNA, 865 bp, Homo sapiens
  Payload ID: 3393
  Gene Symbol: C8orf46
  Gene Name: chromosome 8 open reading frame 46
  ENST ID: ENST00000480005
  CDS Start-End: 23-466
acttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagagggtaagtgctgcgtctctggccccactgcctgtggcctcccactgtcctgatccttccttccccagaagagcaccaggccgcctggttgacagaccctcgagaggccaacacaaacccatgccagctgcaaattatcttttaatgaggccaataatcctgggtctctgcagcgcctcatcaactgtttccctaggattaagcaggagggtttttcatggtttccacttcattaacgccactctttaggcttggagaagtcatttgggaggttttttggttaattagatgaatgtaatcacgagccatattcagaacctcccataggcatgcaggcgtcagaaatatctcatgagtaagttcaagatcccctgcccaccggttaagaagtgtgtcaagtacaaag

SEQ ID NO: 119416 - DNA, 1347 bp, Homo sapiens
  Payload ID: 3393
  Gene Symbol: C8orf46
  Gene Name: chromosome 8 open reading frame 46
  Uniprot ID: Q8TAG6
  ENST ID: ENST00000522977
  CDS Start-End: 44-448
agaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaa

SEQ ID NO: 119417 - DNA, 3313 bp, Homo sapiens
  Payload ID: 3393
  Gene Symbol: C8orf46
  Gene Name: chromosome 8 open reading frame 46
  ENST ID: ENST00000460144
  CDS Start-End: 89-322
gagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatattttgtcgctgttcctagaattcactggaatcacgaaggatccagaaactccctcgatgcgagctccatctgcaaagctcctgccctggggttccatgggtccctaggcccgagcagaggagtgggctaaccgcgtttcccccgcccggcaggtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgacattcatgcaccaccataa

SEQ ID NO: 119418 - DNA, 557 bp, Homo sapiens
  Payload ID: 3393
  Gene Symbol: C8orf46
  Gene Name: chromosome 8 open reading frame 46
  ENST ID: ENST00000521495
  CDS Start-End: 130-498
tagcaccagcctgtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgatccagacatctcaagaagatgactgaagagtatccagcccttccccaaggagcagaagcctctctaccactgacaggcagtgctt

SEQ ID NO: 119419 - DNA, 3227 bp, Homo sapiens
  Payload ID: 3393
  Gene Symbol: C8orf46
  Gene Name: chromosome 8 open reading frame 46
  ENST ID: ENST00000450307
  CDS Start-End: 88-234
agccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatactctacttgaccaagggtaactgaaaccatagatgaaagggactactgtatactatcagcaaatcctgagaagctgcagaagagaggggttaggtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatatgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttg

SEQ ID NO: 119420 - DNA, 1445 bp, Homo sapiens
  Payload ID: 3394
  Gene Symbol: C8orf48
  Gene Name: chromosome 8 open reading frame 48
  Uniprot ID: Q96LL4
  ENST ID: ENST00000297324
  CDS Start-End: 150-1109
aagacagctgggaaggcgtctcccggaagacgacctccgcagagctgatggcattgagatccattcccggaggggtcagctcctgacgggttcctgagccagtcttaacctgggcaaaggagatgaggagccgagcctgatgcattgtgatggccatctgcccagaattggcccaaacggacaaaagtgctcttgcaaacctttctgatgagactgagactttgaagaactctactgatgaggtacagacttccagctcattcagctcctctggaggacggcagtcctcgcccctgacctctgggagcaaactggagagggaaaagcagactccaagcttggaacaaggagacacacaatctgagcttttggactataaaaattatgaaaagaagttgagtaaaaaatggatcaactacctcaagctcaaagactctaactttgaacggcaccaaccagacaccaaacttccaacagaaatcactcgggtatcagatgaagaattgaatgccctgcagtcttattgcaccatgaagataaatttgattcatcgtagaggggattctaagaagaagacgagcagcagacataaaaagctgcatcttggattggatgtagaggcttcagagagagatgcctttagttgtactgtacccgatgaacttttgaacagaatctactttaaaaacatgaggacaacgccaaaacaggaggcagcagctaagcaacacatatcttatcagtgtccctattgtaacaggaaaagagcggagctggccctgtctgcctttctgaaacaaaagaagactttactggagtcatttctactccaagagagaatagatgaacatcttcataccaaagactttctcacccgtattggagaagcacatcaagactttcccaggctttcagatgaccccagaataatctggaaaagactgactgagaaaagtcatatcagatactctggttttgaaagatcagagacagagcagaagttgcagcgagatggaaatagtgcttgtcatttaccattttctctgccatttctcaagcgacttactctaatcaaaccagagctggtgattgttaatgataatgtgtaatgtggatagatgtctttgttgtgtatttgagtaattaccataatttctacaggcacttgggaaactaacttaagactttactatgcttccttcacagatttgaggactaagaactttcactttttttttcctattatagaaggcactgttgtagttggaatagttataaaaacttttacaaaattccaagagaactatgttggtagtttgggccaggatgttgatggtacagaagcaaagtagtatggggatgtaagagaaacttaaaaagtaataactgtctttggcgatcaaatggctatggggaattaataaatagtagatgtttgaaatgtt

SEQ ID NO: 119421 - DNA, 2016 bp, Homo sapiens
  Payload ID: 3395
  Gene Symbol: C8orf58
  Gene Name: chromosome 8 open reading frame 58
  Uniprot ID: Q8NAV2
  ENST ID: ENST00000289989
  CDS Start-End: 75-1172
cccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaa

SEQ ID NO: 119422 - DNA, 2021 bp, Homo sapiens
  Payload ID: 3395
  Gene Symbol: C8orf58
  Gene Name: chromosome 8 open reading frame 58
  Uniprot ID: Q8NAV2
  ENST ID: ENST00000409586
  CDS Start-End: 121-1194
gtctgggggccgcgcccagctgggtcgggacgcgctccctgagctgcccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcc

SEQ ID NO: 119423 - DNA, 448 bp, Homo sapiens
  Payload ID: 3395
  Gene Symbol: C8orf58
  Gene Name: chromosome 8 open reading frame 58
  ENST ID: ENST00000475994
  CDS Start-End: 4-448
cagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggtgaggggccatcgtgtctccctttgtcctgcctgcctggggtcccaccagcaggtcctctgagccgaagcttgatggggtgtcttctggccctggccaacctgactgtctttctgaaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctg

SEQ ID NO: 119424 - DNA, 807 bp, Homo sapiens
  Payload ID: 3395
  Gene Symbol: C8orf58
  Gene Name: chromosome 8 open reading frame 58
  ENST ID: ENST00000495957
  CDS Start-End: 1-526
ctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggtaggggacaggtatatgtggggcaggtggtgggctggggtggggggaggggaggtgggggatgcatgggcaccctgggggccagcaactctggggaaatgacaggattgattcctgtttggagcaggcgacttgtcctggctgtggcgacagctgtctctgggagcttggtcgggggtctgagtgtggggagggctctgggtgacccctcatcctctgctcagcgggatatctcccactgggacaaggtcaaggtcctgctcaaccggatctgccggagaagccaccaccaccctgagccccctgcccctcctgatggctctgaccccaggtgagccccgtgcccagcccaggttagggcacggagaggagactgataagccaggatgctgagattgtcatgccagttgtcattattgtccccgcaaaacttgagaggcagtctgggaggggctgctagaagaaacagtagttaaaacaccccatttacagataaggaggcagggttctgggtggggttgggggtagttgcttttccaaagccgcacggtgagtcagtgacagctaggaccagaatgtgggaaatctgcctaccctagctcagcaacccctcacc

SEQ ID NO: 119425 - DNA, 1955 bp, Homo sapiens
  Payload ID: 3395
  Gene Symbol: C8orf58
  Gene Name: chromosome 8 open reading frame 58
  ENST ID: ENST00000614574
  CDS Start-End: 121-1023
gtctgggggccgcgcccagctgggtcgggacgcgctccctgagctgcccgagctccgcggggactcgggccgggatcctcgggcggctgcattggccggggccggggccgggagcgggccatgatgggccggcggcgcgccttcgccgtggacggccgggatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaa

SEQ ID NO: 119426 - DNA, 1848 bp, Homo sapiens
  Payload ID: 3395
  Gene Symbol: C8orf58
  Gene Name: chromosome 8 open reading frame 58
  ENST ID: ENST00000615223
  CDS Start-End: 128-1114
cagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggaggtgttggagcggtcccgccggctcccaacagctcccaccagcttgtcaggacaacaccgctccctgcggctggcaagcaagcctgagcgtgaagtgccccttggagcagggcaacaggagtccatggaggcagacacagacctagaggcaggcctggaagaagaggcggtggggggcctggggcctggagcctgggcctgcctccccgggcagggtcttcgctatctggaacacctgtgcctggtgctggagcagatggcaaggctccagcagctctacctgcagctgcggatccagaggcccccaggggatcccggcgaggaggagtcgacccgagcccctttaccgtccccgttacacaccccaggcaatcgggggcaggggccatgggagctgctaagccagacagagcacacaggagcaaaggctgcttcacccccaaaggtggaggtgcccagtgccaaccctcccaggctgccagaaaccccagtggagccaacgtaccacttgccatcctcccagggacacaagcgggatatctcccactgggacaaggtcaaggtcctgctcaaccggatctgccggagaagccaccaccaccctgagccccctgcccctcctgatggctctgaccccaggatcgagtccagggacctccctgaaaggcctcagtgccgcccccaccggaagacctttatgccatcattagtggttaagaagcaacgagcaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgt

SEQ ID NO: 119427 - DNA, 325 bp, Homo sapiens
  Payload ID: 3396
  Gene Symbol: C8orf59
  Gene Name: chromosome 8 open reading frame 59
  Uniprot ID: Q8N0T1
  ENST ID: ENST00000321777
  CDS Start-End: 79-210
gcttaaaaagctgcacgcaagtgttaaacttctgtaggaggaatactgttggcgttcaaaagcattgctgtttcaacaatggccaagaacaaattaagagggccgaagtccaggaatgtatttcacatagccagccaaaaaaactttaaggctaaaaacaaagcaaaaccagttaccactaatcttaagaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaa

SEQ ID NO: 119428 - DNA, 756 bp, Homo sapiens
  Payload ID: 3396
  Gene Symbol: C8orf59
  Gene Name: chromosome 8 open reading frame 59
  ENST ID: ENST00000523281
  CDS Start-End: 620-756
gttaagtagttccttaattacttacaatgtagtaaggctacattgaaggaagatataaatttcagtcaagactacgactgagcaaaggtaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaa

SEQ ID NO: 119429 - DNA, 491 bp, Homo sapiens
  Payload ID: 3396
  Gene Symbol: C8orf59
  Gene Name: chromosome 8 open reading frame 59
  ENST ID: ENST00000545322
  CDS Start-End: 248-433
acggctcgtgagcggaatcctgactggttcatcctccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaattctccacaaagaccaataaattgaatgttttatacaa

SEQ ID NO: 119430 - DNA, 734 bp, Homo sapiens
  Payload ID: 3396
  Gene Symbol: C8orf59
  Gene Name: chromosome 8 open reading frame 59
  ENST ID: ENST00000614462
  CDS Start-End: 66-251
ccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtt

SEQ ID NO: 119431 - DNA, 475 bp, Homo sapiens
  Payload ID: 3396
  Gene Symbol: C8orf59
  Gene Name: chromosome 8 open reading frame 59
  Uniprot ID: Q8N0T1
  ENST ID: ENST00000612809
  CDS Start-End: 115-417
cctagacgccgtacgtgccagatggtgttacctggagcttaaaaagctgcacgcaagtgttaaacttctgtaggaggaatactgttggcgttcaaaagcattgctgtttcaacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaa

SEQ ID NO: 119432 - DNA, 483 bp, Homo sapiens
  Payload ID: 3396
  Gene Symbol: C8orf59
  Gene Name: chromosome 8 open reading frame 59
  Uniprot ID: Q8N0T1
  ENST ID: ENST00000615697
  CDS Start-End: 177-479
tggtgttacctggagcttaaaaagctgcacgcaagtgttaaacttctggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatata

SEQ ID NO: 119433 - DNA, 586 bp, Homo sapiens
  Payload ID: 3396
  Gene Symbol: C8orf59
  Gene Name: chromosome 8 open reading frame 59
  Uniprot ID: Q8N0T1
  ENST ID: ENST00000612977
  CDS Start-End: 211-513
ccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaa

SEQ ID NO: 119434 - DNA, 859 bp, Homo sapiens
  Payload ID: 3396
  Gene Symbol: C8orf59
  Gene Name: chromosome 8 open reading frame 59
  Uniprot ID: Q8N0T1
  ENST ID: ENST00000619594
  CDS Start-End: 73-375
ctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgttt

SEQ ID NO: 119435 - DNA, 563 bp, Homo sapiens
  Payload ID: 3396
  Gene Symbol: C8orf59
  Gene Name: chromosome 8 open reading frame 59
  Uniprot ID: Q8N0T1
  ENST ID: ENST00000611854
  CDS Start-End: 204-506
agaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaatggccaagaacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 119436 - DNA, 1036 bp, Homo sapiens
  Payload ID: 3397
  Gene Symbol: C8orf74
  Gene Name: chromosome 8 open reading frame 74
  Uniprot ID: Q6P047
  ENST ID: ENST00000304519
  CDS Start-End: 30-914
ccgtctcctggcaaccagatgcaggggccatggcactcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccaccccatcccctcccgctggccgagggcatggacagggacttgtggatccacgagcagcaggtggccacactgacggaggccgaggcacagaagcgcgccgacgtgctgctcctgaaagaggcgctgcgcctggagcgggagaactcgctgcagaaggcgttcgctgccgccgcgcctgcgcagcccggccaggtcctggagagacaggagttggagagcctcatctgccaggcagtccacacccagatggagctcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgagccttgcggcacggtgagctcagcacccacagagagacttcttgtgattaaaagaaacaaacccatgc

SEQ ID NO: 119437 - DNA, 2338 bp, Homo sapiens
  Payload ID: 3397
  Gene Symbol: C8orf74
  Gene Name: chromosome 8 open reading frame 74
  ENST ID: ENST00000521818
  CDS Start-End: 1-298
actcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggtgctggcctccaggggcttggggaccatcttcaggaagttcccagcagccaatgcaaatgagggccactccctgttattgaagagcaacttgcaggcacagatctgtccgcccggcagccagcggcttctccctgagacttaatccctccactttctgagtcaccaggaacttctcaacccgaggcccagggagtgtggtccgaggccaagaaagtgtgtctcataagccggcttccaacaagctttgctgaaacccagaaccagccaagagtgtctgggggccgaaagttagaattcagcccagggactccttccctgttgacccaggacaaggtctacacttggtttgtatgacctcttaggagcaggtcacagcccatggccacagtggggcatcggccaggatgataagccgccaggacacccaggcacggctgctgagcacattcacactactgagcctggcagacttctcttttcagatctgggttttgtgtacggctgctggggctgaacagaagggctcagaggctggccttcgccaatgaggcagacacagccacccacagctgcaggatgcaggtgaccccaccccatgctccgtcaggccaggccaggctggaggaggagcagggcaccttctggcaagttcagagaaggtgtgatgagtcatctgatgaagctcacacactgtcgcacacacacaggcccagagtccagcttgctgatcaaaaatgatggcctcatgcctgctcaccctctgggatccctcaatgggcagcctctgctgtcctccatgcggccaccgacttccctctgggatggccccaacctctcacgtctggcctcagtacctctccaccaggttcttaaccccaaggaatttgataatcctatgtacgctatccttggaggtcctggtgttccgtgatgaagtcaactctttcacatggcacatagggctgtcatgaaccaccctgtccaaactgaccacaagccctgggtcccccagctcagtccgcagaatccagttttgcctcctggacagctgggtgtggccctgtgcacgcagccatgctgtgcccctctcacttccggccttcactgctcctggcccctctgcttggggtggcctttcccaccatcctctggactccagcctggtgcccccgacacggggcatgtgcagacgccctggcctctcagagctccttcttatctcactgcatccctgcggggaagctcctgccaattgatggcaggcctgcacgctctgatgcccagctctgagtgaaaggacaggaagggacacagggcgtgtggggccaggggttctctgctgttctgagggcagcagcagccaagagcttctggtcagtgaagcaagacctggaccctgccctaggctgatccccgccgaggccttggcccttccttccgacacagctcgttcctcctgctgccagaattggctccctggaacctggctccgctcaccccctacctgctggaaacccttctgccatgtctgggtgggcctggcctttggggcctgctctgccagcccagcagcctccatggtgaaagccttggccacaggcaacatcccccagcacctggcacatgggaatgttccctaaataaatccttttgtgtgtgtgtgagacaagctctcaccctgtcatccagactggactgcagtggcacgatctgtagccttgacctcctgggctcaagtgatccttctatctcaacctcctgagtagctgggactaaaggcatgcaccaccatgctggctatttttttttttttatagtgttcgggtctttctatgttgcccaggctggtcttgaactcccaggctcaagggatacccctgccatggcctctgaaagtgctgtggccgcccattcccttgtgtccattcaagaagtctctccttctctgcagagcacctcctgggagctgggcactgctctggcacttggcacccagcagtgaacagaaaagaccgcctctcgctccctcgcagcttgagtgatagtggagggaaaatgaccaagaacaaatcacacaagtaaaatgcacaagatcaaaga

SEQ ID NO: 119438 - DNA, 1201 bp, Homo sapiens
  Payload ID: 3397
  Gene Symbol: C8orf74
  Gene Name: chromosome 8 open reading frame 74
  ENST ID: ENST00000523289
  CDS Start-End: 6-305
gggccatggcactcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggttcagtccaggagcccacacagcccaccagctgtgtaggaatgccagcagaggcctgatgatggcaatgacggtgacaatggcattacttattgagtgtttactgtgtaccaggcactgtggaaagcaccacatatgcatgctgtcgcctaatctcacgaggtagagatttttattgcctctattttacaggctgctccattactgaggctgtgacgatcctggggaacaagcttagagattaccggggccatttcaacaccacccacctgctggccctctgtgactacttccaccacaccttcatccgccactacaaactctaccagtatgtcctgggccaggaccagcaggtcgacctgaccgttgcccacctggaggtgtgcatgccaccccatcccctcccgctggccgagggcatggacagggacttgtggatccacgagcagcaggtggccacactgacggaggccgaggcacagaagcgcgccgacgtgctgctcctgaaagaggcgctgcgcctggagcgggagaactcgctgcagaaggcgttcgctgccgccgcgcctgcgcagcccggccaggtcctggagagacaggagttggagagcctcatctgccaggcagtccacacccagatggagctcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgagccttgcggcacggtgagctcagcacccacagagagacttcttgtgattaaaagaaacaaaccca

SEQ ID NO: 119439 - DNA, 1919 bp, Homo sapiens
  Payload ID: 3397
  Gene Symbol: C8orf74
  Gene Name: chromosome 8 open reading frame 74
  ENST ID: ENST00000523723
  CDS Start-End: 14-313
agatgcaggggccatggcactcttaacaccccagggagtgaaagaagtcttccaacttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggttcagtccaggagcccacacagcccaccagctgtgtaggaatgccagcagaggcctgatgatggcaatgacggtgacaatggcattacttattgagtgtttactgtgtaccaggcactgtggaaagcaccacatatgcatgctgtcgcctaatctcacgaggtagagatttttattgcctctattttacagaaactactactgacttctaacatcatagttgggccagttttaataaatggaataaaaaagacaaagaaagagaacactgatgcccagagaggccaaataacttctgcaagtgatgaagttgtgcagcctgaggttagcctgcatctgcctgaatccccagtctgtgctcataccagacataccctactgcccctgacagaggagccgagcttcaaggaatggccccagcatcagtgccatcttcagtcccatcttcagtccaggtgttccctaggcgcaatggtggctgctgtgtgaccgtgaatggtggctgagaacagaacacacagctattgaatccttggtgcccaagtcacagggcaggaggatgatgcatctccagccagcgtggtcctcctttggccagtccgggcccatcctgatgaggtcaggagggatgcagctgctcctcttcccccatgggagtgtcaggcccaaccagcctgccctctctcctctccctgcagtttaccaggtggctttggaaaggggtcaccctgaagggaccacttgtgctgcagtaggaggtgggaagatcaacagaccacggaccccgggacaggcaggagccacagaagaggtctcaagcaaaggtggcaagctctcagggctcttcctgacaatcctgcctgtccccaggccgtggacagcaggtcagccacaaagctaactcccaagaacagcacctggcccagtctccttccctggctcctccgttcccttccctgggcagacagtgccccagccaagctttcacagacatttctgacctatcaaaaagcaccagggctggggcaatgaaaagaaatagacaccaatcccttccctacacagggagtggtgatggggaaggcagctctaccaccaggttcccgacccctcacacctgggctgaagctcaggtcctgactttgccacaggttagctttaggcaagtctcatcctttttctgggcctcagtttccccatttgtagagaaaaacgattgtacaagctcaacatttctccttggtccagagagatgtgctccttggtccagagagactacttgccccaaatagatttgagaagcattgcaaacgctccatgccttttggtgatctgctaagctcatttgcatattttgttgagctcattagcatattaaagctctatttaatctccctggatccaacatctcttaaagggtctctctggctgtgaaacattcattttgatatacaggtgactcttgaagaacacgagatttagggccgccaacctcctgtgcggttgaaaacccatgtgtaactttggactcttccagaatttacttactcatagcctaccgttgaccagaagcttactgataatataaacagtcgattcccatacattttgtatgtaatatgtattatgtactgtgttcttacaataaagtaggctgaagaaaag

SEQ ID NO: 119440 - DNA, 1341 bp, Homo sapiens
  Payload ID: 3398
  Gene Symbol: C8orf76
  Gene Name: chromosome 8 open reading frame 76
  Uniprot ID: Q96K31
  ENST ID: ENST00000276704
  CDS Start-End: 53-1195
ccgccttttccggcgggccccgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgc

SEQ ID NO: 119441 - DNA, 2186 bp, Homo sapiens
  Payload ID: 3399
  Gene Symbol: C8orf82
  Gene Name: chromosome 8 open reading frame 82
  ENST ID: ENST00000313465
  CDS Start-End: 177-437
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaaggtaatgctgtgcctccctctccagccccttctttctcccttccgggcagcccctgatgggctccccgactctgccgacgggcccagcgcaccaaggagtgggcgtcctgcgctcaggagccccgctgagtgaggccaggcgaacctcttaccgtcggcgcctgccctcggtatggtcctgggcccggaggccttgggagcccagcgcgctgagtacacgcacccttcatcccccagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccgctccccacggcgcgcgccccccgcgcacccgactccggcgccctccggattggcctgcgctcgagacgtcaggcactggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgctta

SEQ ID NO: 119442 - DNA, 1637 bp, Homo sapiens
  Payload ID: 3399
  Gene Symbol: C8orf82
  Gene Name: chromosome 8 open reading frame 82
  Uniprot ID: Q6P1X6
  ENST ID: ENST00000534680
  CDS Start-End: 217-867
gcggggcggaccggaaggggcgtcaccggcacacgcctctcggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccgctccccacggcgcgcgccccccgcgcacccgactccggcgccctccggattggcctgcgctcgagacgtcaggcactggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaa

SEQ ID NO: 119443 - DNA, 401 bp, Homo sapiens
  Payload ID: 3399
  Gene Symbol: C8orf82
  Gene Name: chromosome 8 open reading frame 82
  ENST ID: ENST00000527462
  CDS Start-End: 1-401
cccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagtccccagccccggcgctgacttctcgccgctgccagggagacacccgggccgccctgcctttttttggaagccctgtcaaaaggcagctgcatgtccgg

SEQ ID NO: 119444 - DNA, 2476 bp, Homo sapiens
  Payload ID: 3399
  Gene Symbol: C8orf82
  Gene Name: chromosome 8 open reading frame 82
  Uniprot ID: Q6P1X6
  ENST ID: ENST00000524821
  CDS Start-End: 217-867
gcggggcggaccggaaggggcgtcaccggcacacgcctctcggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccgctccccacggcgcgcgccccccgcgcacccgactccggcgccctccggattggcctgcgctcgagacgtcaggcactggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttacttatttctagtgactttaaataatcatgtgagttacaatttagggcaagatttaaacaccaaggccacttggtcctgtccctttccacatgactcgaaaggaggaagagctgatggacaggcaaatgtttggggaggccggccagatgaggctgggagacaggacacctgcagccctgttttccctggcttcgggtgggctggctggcttagcccagatccctacttttaaaactgggctccttgttcctgaaaccagaccccagccttcccatttctttacgacaagtacatgtatatggtcccccagcaaactccctgctccttgctgatctcagaggtcacactgctcccagagcccacttgggaagccacaccagaaacccagttggtggcccaaggcgtcccctgtcccaccccagctttcccagggccccatctatccccaaagacaggacacctttctggggaccggcatgggaagca

SEQ ID NO: 119445 - DNA, 802 bp, Homo sapiens
  Payload ID: 3399
  Gene Symbol: C8orf82
  Gene Name: chromosome 8 open reading frame 82
  ENST ID: ENST00000532827
  CDS Start-End: 1-784
cggggagttgggtcggtccgggccgaggctcctacatgggccgcgtccctgctgcgttgtgcagcttcggactctgtcctacaagtccccagccccggcgctgacttctcgccgctgccagggagacacccgggccgccctgcctttttttggaagccctgtcaaaaggcagctgcatgtccgggaggcagcaggccaggtagtctccgcggaggaggtggtacaactgattacaaacttgaaaagagggaaaaggtgcgggaaagaattggctgaccagggagcagagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaagg

SEQ ID NO: 119446 - DNA, 2250 bp, Homo sapiens
  Payload ID: 3400
  Gene Symbol: C8orf86
  Gene Name: chromosome 8 open reading frame 86
  Uniprot ID: Q6ZUL3
  ENST ID: ENST00000358138
  CDS Start-End: 26-697
aagagatgctcaggtcagggagggaatgagacccctggggaagggactcctcccagctgaggagttgattagaagcaatcttggagttggcaggagccttagagactgcctgagccagtccgggaagctggctgaggagcttgggagcaagagactaaaaccagccaagtttgggacagaagggaaggaaagggttgagcagcgaacagagagacaaagaacaggcagttccaaagagccaagaatgcaaatcatttgcagacgccgctggcgagagcctccaccaaggctgctgtgggggtgcctgatgccacgagcacagccacttctacacgtcacggcttatgagaatacaggccactgggagagactcgcatctgtggtttcttcaaaaacacagcagcccacagtgatctctcattcttccatttctatcacattcagtcattaccctccagccacactggactcctttcttgtcctggaacctatcaaactctttcctgtctcaagcctccgcagtcctctctgcttgaactgtggctcctgcagagaaagcatcagaatctccggggaactgattggaaatgcacattctccagccccgcccagaactcctgaattagaaaccctggggtgggacaagcaagccgtgctttctggggcacaggtgattctggtgtgtgctgaagtttaagaaccactggccgagaacattcttaggtctgctcttcttttgcccggcccctccctcgcggaggaattccttcttattcctctctgaagagtggctgctgccaaaaaacgtttgtgagatggcctgggttttctttgttgatttatcatttagtttggaagaaatcagaagtctctttaagaagccaatttgaaacattcaccccatgggaacagttctggatgaagtcagaagatctggaggcagcgcagtaacacacgtaggttttctggccatatggacatttcagagaaaacaacgcacagaggcctggagcaggtgaactggcttaagtagagagaaactaagtcatttggggatatttagcacctaatgtcaaggcagaaatgtctaagatgtaattaacagttatattctaatctcaatagtagctaagtacagacttaaacataagcctgtatataacaaaataaccccaggagaaccaaagaaaatctagaagttgctgctaaaaacagttatgttagtgatacctaggaaagttttttttcttttaacatgtcattgtggtttacaaatgaaaattgaggccgggcgtggtggctcacgcctgtaatcccagcacttttggaggccaaggtgggcgaatcacaaggtcaggagttcaagaccagtctggccaacatggtgaaaccccatctttactaaaaatacaaaaaattagctgggcgtggtggtgggcgcctgtaatctcagctactagggaggctgaggaaggagaatcgcttgaacctgggaggcggaggttgcagtgagccaagatcatgccaccgcactccagcctgggcaacagtgtgagactccatctcaaaacaaacaaacaaacaaatgaaacaaatgaaaattgaaacttcacccatttatggctattgcctaaagaatttataaatgcctgggtcattgcaagcatattgctgacatgtctctcggtctgcgttaccctggtggacatcacgacactcacctgacaggcagcagcttccttccagtaaaagcaaagaatctgaaaggaatggaaaaggctccacacagtgccattttatagaaggaaatgcaacaaggtcacagaccagaaggacagcagcccaggccggctgggcatggaggaagtcccaagatgctgctgggcatgaacagacctcctcatacagtgtgcctctgaagaaataatgcaattgtgtggggccagaggagccacaaatagaacaaagggaggaaaggaaaaatcaatatgcagtaaagaggaggaagggagcccggcgcgatgtctgaatctcgctggcaagaaaaggaaacaggtggtctaagcaggcaacccttcaccccacattgtaatgctggggcatggacgtgttccatagatcactcactgagaagtcttcacaagaacactccaaggcagacactactatccatcttccacacactgggggattgagagtcagaaggattatacagcttgttcaaattataaataaaagccctgagatttg

SEQ ID NO: 119447 - DNA, 1527 bp, Homo sapiens
  Payload ID: 3400
  Gene Symbol: C8orf86
  Gene Name: chromosome 8 open reading frame 86
  Uniprot ID: Q6ZUL3
  ENST ID: ENST00000437935
  CDS Start-End: 21-443
atgctcaggtcagggagggaatgagacccctggggaagggactcctcccagctgaggagttgattagaagcaatcttggagttggcaggagccttagagactgcctgagccagtccgggaagctggctgaggagcttgggagcaagagactaaaaccagccaagtttgggacagaagggaaggaaagggttgagcagcgaacagagagacaaagaacaggcagttccaaagagccaagaatgcaaatcatttgcagacgccgctggcgagagcctccaccaaggctgctgtgggggtgcctgatgccacgagcacagccacttctacacgtcacgcctccgcagtcctctctgcttgaactgtggctcctgcagagaaagcatcagaatctccggggaactgattggaaatgcacattctccagccccgcccagaactcctgaattagaaaccctggggtgggacaagcaagccgtgctttctggggcacaggtgattctggtgtgtgctgaagtttaagaaccactggccgagaacattcttaggtctgctcttcttttgcccggcccctccctcgcggaggaattccttcttattcctctctgaagagtggctgctgccaaaaaacgtttgtgagatggcctgggttttctttgttgatttatcatttagtttggaagaaatcagaagtctctttaagaagccaatttgaaacattcaccccatgggaacagttctggatgaagtcagaagatctggaggcagcgcagtaacacacgtaggttttctggccatatggacatttcagagaaaacaacgcacagaggcctggagcaggtgaactggcttaagtagagagaaactaagtcatttggggatatttagcacctaatgtcaaggcagaaatgtctaagatgtaattaacagttatattctaatctcaatagtagctaagtacagacttaaacataagcctgtatataacaaaataaccccaggagaaccaaagaaaatctagaagttgctgctaaaaacagttatgttagtgatacctaggaaagttttttttcttttaacatgtcattgtggtttacaaatgaaaattgaggccgggcgtggtggctcacgcctgtaatcccagcacttttggaggccaaggtgggcgaatcacaaggtcaggagttcaagaccagtctggccaacatggtgaaaccccatctttactaaaaatacaaaaaattagctgggcgtggtggtgggcgcctgtaatctcagctactagggaggctgaggaaggagaatcgcttgaacctgggaggcggaggttgcagtgagccaagatcatgccaccgcactccagcctgggcaacagtgtgagactccatctcaaaacaaacaaacaaacaaatgaaacaaatgaaaattgaaacttcacccatttatggctattgcctaaagaatttataaatgcctgggtcattgcaagcatattgctgacatgtctctcggtctgcgttaccctggtgg

SEQ ID NO: 119448 - DNA, 894 bp, Homo sapiens
  Payload ID: 3401
  Gene Symbol: C8orf88
  Gene Name: chromosome 8 open reading frame 88
  Uniprot ID: P0DMB2
  ENST ID: ENST00000517562
  CDS Start-End: 171-524
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgta

SEQ ID NO: 119449 - DNA, 495 bp, Homo sapiens
  Payload ID: 3402
  Gene Symbol: C8orf89
  Gene Name: chromosome 8 open reading frame 89
  ENST ID: ENST00000613105
  CDS Start-End: 45-272
gcagcagcatctccctctcatcagcactgttgaaagaagaaaaaatgtcagtgctatctcctgaaatcaaatgtgagacttctaaattcaccagaagttcctttggcagttgtttgatttttgagagtagttggaagaaagcagttttagaaacacaaaagattaagaaagaatataccacagcatttggtctagaagagctcaaggaatgtatcaaaatgccatatttaccaggactgcaaagttgccaaaaaagtgctaaagaagactaaggagacatgcagtgtggcaccactttgggagaaatcaaaaggttctggcttcagtgatcctctcactggagcaccatctcaatacttagagagactttccaaaatagccatattggaatatgataccattcgtcaggaaacaaccacaaaatcaaaaaaaagcaagaaacgagacctccgagaccgctgaaaaatgtcgtacagtgtgatgctttcttcagtg

SEQ ID NO: 119450 - DNA, 507 bp, Homo sapiens
  Payload ID: 3402
  Gene Symbol: C8orf89
  Gene Name: chromosome 8 open reading frame 89
  ENST ID: ENST00000625134
  CDS Start-End: 45-341
gcagcagcatctccctctcatcagcactgttgaaagaagaaaaaatgtcagtgctatctcctgaaatcaaatgtgagacttctaaattcaccagaagttcctttggcagttgtttgatttttgagagtagttggaagaaagcagttttagaaacacaaaagattaagaaagaatataccacagcatttggtctagaagagctcaaggaatgtatcaaaatgccatatttaccaggactgcaaagttgccaaaaaagtgtaagttcaactccactagaggttcctaaaagactgccacgtgctgatgccgaggtgtctgcagtcaggttctggcttcagtgatcctctcactggagcaccatctcaatacttagagagactttccaaaatagccatattggaatatgataccattcgtcaggaaacaaccacaaaatcaaaaaaaagcaagaaacgagacctccgagaccgctgaaaaatgtcgtacagtgtgatgctttcttcagtg

SEQ ID NO: 119451 - DNA, 658 bp, Homo sapiens
  Payload ID: 3402
  Gene Symbol: C8orf89
  Gene Name: chromosome 8 open reading frame 89
  Uniprot ID: P0DMQ9
  ENST ID: ENST00000624510
  CDS Start-End: 45-530
gcagcagcatctccctctcatcagcactgttgaaagaagaaaaaatgtcagtgctatctcctgaaatcaaatgtgagacttctaaattcaccagaagttcctttggcagttgtttgatttttgagagtagttggaagaaagcagttttagaaacacaaaagattaagaaagaatataccacagcatttggtctagaagagctcaaggaatgtatcaaaatgccatatttaccaggactgcaaagttgccaaaaaagtgtaagttcaactccactagaggttcctaaaagactgccacgtgctgatgccgaggtgtctgcagtcaggctaaagaagactaaggagacatgcagtgtggcaccactttgggagaaatcaaaaggttctggcttcagtgatcctctcactggagcaccatctcaatacttagagagactttccaaaatagccatattggaatatgataccattcgtcaggaaacaaccacaaaatcaaaaaaaagcaagaaacgagacctccgagaccgctgaaaaatgtcgtacagtgtgatgctttcttcagtgacttttaagctttatattttctttttttatatgatatgatgcaaaatgatttatataaaaatggaaatgtaaataaataaatattttacattata

SEQ ID NO: 119452 - DNA, 4286 bp, Homo sapiens
  Payload ID: 3403
  Gene Symbol: C9orf114
  Gene Name: chromosome 9 open reading frame 114
  Uniprot ID: Q5T280
  ENST ID: ENST00000361256
  CDS Start-End: 42-1172
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcatgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaa

SEQ ID NO: 119453 - DNA, 898 bp, Homo sapiens
  Payload ID: 3403
  Gene Symbol: C9orf114
  Gene Name: chromosome 9 open reading frame 114
  ENST ID: ENST00000467582
  CDS Start-End: 1-264
accaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcga

SEQ ID NO: 119454 - DNA, 4280 bp, Homo sapiens
  Payload ID: 3403
  Gene Symbol: C9orf114
  Gene Name: chromosome 9 open reading frame 114
  ENST ID: ENST00000622809
  CDS Start-End: 42-1208
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctgacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttggaagaaggggcaggcgtgcgtacagctggcccggatcctgcagtacctgagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcatgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgt

SEQ ID NO: 119455 - DNA, 1278 bp, Homo sapiens
  Payload ID: 3404
  Gene Symbol: C9orf116
  Gene Name: chromosome 9 open reading frame 116
  Uniprot ID: Q5BN46
  ENST ID: ENST00000371789
  CDS Start-End: 668-946
agtctcgggcggggagtggagccacggtcctcgccctgcagctcgccccgccctgctaatgggaccggccagcccgggaggcccctgacccttggggaagcccgctgggcgatggggaccctcgcctcccgccaagtgagctgtgaaccacgtcctgcgcaacctctcgctctccaaaactgtttgtaatatttaaacgatatttggcttaggagaatttcataaagttagccagatctcgggtctcaatttagactcggggtgctggggggcatagcatccctggagtacattggacagcaaaagtccaatcgttgcctgccgagtggacctgcagtgcttaaaccccgtcacccggctggcggggtcccaggccctggggtttctttcgcccgggagtccacgccctgatgctggggtggcccggtccccccgcgggtggctgggggcctggggctgcctcacacgacggtcccagcagggaatctctcgccgtcccgaccttcccggcccttggggagtcgcccggcaggttccggacccacccgcagaggaacccggcccacgcgcggcgcctttaaggcccctccgctcgctccccagtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 119456 - DNA, 781 bp, Homo sapiens
  Payload ID: 3404
  Gene Symbol: C9orf116
  Gene Name: chromosome 9 open reading frame 116
  Uniprot ID: Q5BN46
  ENST ID: ENST00000371791
  CDS Start-End: 171-449
gtggggagccgggagcccagcagccccaggaaagacctggaagcacagggaccttttcaggaaacagagggctggagccaggttctgatcccgaccttgctcctggtcacgtgacctggccgtcgcttggcaacaggacgccgccgagtcccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 119457 - DNA, 678 bp, Homo sapiens
  Payload ID: 3404
  Gene Symbol: C9orf116
  Gene Name: chromosome 9 open reading frame 116
  Uniprot ID: Q5BN46
  ENST ID: ENST00000429260
  CDS Start-End: 22-432
cccgcttctcctccaggcacaatggctgaggaatgccccagagcgtgcgcggagcctgtggcgcccaaggccacggccccgccggagaggaccagcgactactaccgcgtgagcgcggacctgccgggcaggttcaacaacccggggtggttccggggctacaggacccagaaggctgtctccgtgtacaggaccagtaaccaggcttacgggagcagagcccccaccgtgcacgagatgcctaaagtattttatccaaattcgaataaattttcccaacaacttgcagcgggtggaatgttccggaacaatactctcaatgtttacctggagaaaagcatcgtgactggccccgataactgcatcacctcctgtgaccggctcaacttccaccccagttacaacatcaacaggccatccatctgcgattgaggggctggaaactccctctaggagtcctctgaccccagggcctcctggaaaatcatcatccctcatcacccacagtcgcccgattgtgacggcacagactgcgctgccttccctgaaaatattattcgtctgcggagtaggaaaatatgcaaacggggccgtgaagtcctgccatttcacatctaataagtacatgggaaagatgctaatggttgactttgcattaaaaacgttgtcacatcctga

SEQ ID NO: 119458 - DNA, 273 bp, Homo sapiens
  Payload ID: 3404
  Gene Symbol: C9orf116
  Gene Name: chromosome 9 open reading frame 116
  ENST ID: ENST00000419770
  CDS Start-End: 1-212
ggataagggcagtggggggcagggccgtggggggagaaagcccagttgtggtctcagctccactgatttgtgtcgggacccagaaggctgtctccgtgtacaggaccagtaaccaggcttacgggagcagagcccccaccgtgcacgagatgcctcgggtggaatgttccggaacaatactctcaatgtttacctggagaaaagcatcgtgactggccccgataactgcatcacctcctgtgaccggctcaacttccaccccagttacaacat

SEQ ID NO: 119459 - DNA, 1154 bp, Homo sapiens
  Payload ID: 3405
  Gene Symbol: C9orf129
  Gene Name: chromosome 9 open reading frame 129
  Uniprot ID: Q5T035
  ENST ID: ENST00000375419
  CDS Start-End: 365-955
gcgcaggattcggagctcagaggcccgggccgccggccgcctcccctccgtggctctagggcggaggcggaggcggggaccggggtatctcgctcgcgcagcctggagcccatgctgggctcagcccgaccctgctttggccgctgcccgccgggtctccagcgccgccggaccctcacgccgccaccttctctccagcccagcgccgctgcggccgcagcctcctgccgagcatcttccagatcccaatccctgagaatcagttctgggatgtaacagagcaagcggacattattctgggaccagcaagcctcggtcactgcagccaccacactacgtggcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtccttgcccatcaacccggcccagagcggcagccccaaccacgtggattccgcctacttccctggctcttctacatcgtcatcttccgacaacgacgagggcagcggaggggcgacaaaatatacaatctattggggattccgtgccactgaccaccatgtacaaggaagggattcacaggcaagggggacagcagcccactggcatggggggcatgtctgctcacctaacgttttctggcggatttctcatggcccagcgcaacaactgacattccctactgagcaagcagctccgccagtgtgccctgccccagcgtcccgccgtctctcagcccctggatgagcccagggaaccggcactctactgaggacaaagcagggctcacctagcaatggaagctcttcaatacttaaggtagctaattcaatgtttgtaaaaggcatttacaacagaaaaccaaagattgaacttcagcttcagatttgtaaaccattcacatctctgcaacttaaaacagtaaataaagattatcaatgcacaa

SEQ ID NO: 119460 - DNA, 3409 bp, Homo sapiens
  Payload ID: 3406
  Gene Symbol: C9orf131
  Gene Name: chromosome 9 open reading frame 131
  Uniprot ID: Q5VYM1
  ENST ID: ENST00000312292
  CDS Start-End: 48-3287
gtgatgcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggtgacactattcttattcgtggtttggcagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattagataaatccca

SEQ ID NO: 119461 - DNA, 3184 bp, Homo sapiens
  Payload ID: 3406
  Gene Symbol: C9orf131
  Gene Name: chromosome 9 open reading frame 131
  Uniprot ID: Q5VYM1
  ENST ID: ENST00000354479
  CDS Start-End: 51-3071
aaaaagaggcaaaggcagagaacaaaggaaggaggaagttaacttgtggaatgctgagaaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattaga

SEQ ID NO: 119462 - DNA, 810 bp, Homo sapiens
  Payload ID: 3406
  Gene Symbol: C9orf131
  Gene Name: chromosome 9 open reading frame 131
  ENST ID: ENST00000378745
  CDS Start-End: 43-810
gcaatgatgacctcagggtaaactgccagaaggctaagggaaatggaatggctgctggaggacctgcttggggctaagggggatatggggcttctctggggccaactgacccatgccctagcctgcagacactgcggcagcagctgcttccagagtccaggaaatctggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttc

SEQ ID NO: 119463 - DNA, 3259 bp, Homo sapiens
  Payload ID: 3406
  Gene Symbol: C9orf131
  Gene Name: chromosome 9 open reading frame 131
  Uniprot ID: Q5VYM1
  ENST ID: ENST00000421362
  CDS Start-End: 51-3146
aaaaagaggcaaaggcagagaacaaaggaaggaggaagttaacttgtggaatgctgagaaagattcagagatggtggcagcttgggaggttgcgacagcttcatccctggtgctctgggaatatggtgcaaggcaaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttcctacctaggtccaacctgttgcttccccagtatcactcctcagcccagttttctacccatggggcccatactatggaagatctagaagggatggcccccgatcctcagctgcttccacctccatcttctccttctgtctcatcactactcctccatctgaggcccttccctgtggaccacaagggagttttatctggcgctgaggcacccacacagtcccctggaactagccccctggaagttctccctggatatgagactcatttggaaaccacaggacacaaaaagatgccccaagcttttgagcctccgatgccacccccctgccaatccccagcttctctgtcagaacccagaaaagttagccctgaaggaggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctacacccagtaccccagcctcccaccctagctgaagctgtgaagattgaacgcactcatcctggtctacccaagggagtaacgtgcccaggggttaaggcagaggccccactctcccagagatggactgtcccagagttgctcacccatcctgggatccatgcctggcagtggagtagagagctgaaactcaggctgaagaaactgcggcagagccctgcctccagagcccctggcccaagtcaatcattttgcagctcccctattctgagctccacaattccagacttctggggactcccttcctgcccaccacagcagatttatccccccaatccatgcccccactcttcaagttgtcatcctcaagaagttcagcgcacagtacctcagcctgtccagtcctcccactgtcatcacttccaatcctcttcccagcttcagccacaggagtctggcagggcggaacaagggtctcagagaggggagaaaatgaaggggaagatggtgagccaggtcccatcccaagggccatgtgtacacatggaggctggtgtggactatctatctccaggcccaggagaaccctcaaactctaaggttctggtctcaggcaagagaaaggacaaggcttcagcctcatcctcagccaaaaagagagagcaccctaggaaacccaaagcaggagaccatagaagagggactgcaaggttggggttatccacagtcacagggaagaaccaccctgcccaggccagaagcctagtagaggcccctgtaagcacatttccccaaaggtctcaacacaggggccagagctctcaacacactgctcttccccagctgcttctccccaaagcttcgggtccccaggatcagccagaggcagggcgaagagcaagtgacatcctgacccctcgccactgtaagcactgtccttgggcccacatggagaagtatctctccttccctaccctcaaggcttcccttaccaggggtttgcaaaaggtgttagccaaatgcctggataaccatcgacccctacccaccaaatctagtcagtagagaaaaggctggtaatactagcacttggtatgccaagacctgaagccaaaccagggggaaggtggggatgtggagacaagaaatggaaattctaataaactagctgaattaga

SEQ ID NO: 119464 - DNA, 571 bp, Homo sapiens
  Payload ID: 3406
  Gene Symbol: C9orf131
  Gene Name: chromosome 9 open reading frame 131
  ENST ID: ENST00000416537
  CDS Start-End: 1-29
tggtgcaaggcaaggtgggtgacctgtgactgtacagctggatgaatgactgctgacaccacatgtgaggtcattggtatgaatgtgggcccaggaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttccagattctgaccagctttcctgtgaggcacaagatagcatcagggaaccgccagcagcagagaaaaagccagctcttctggggtctcccctctctgcacagcgagtccttggaggccatcttcctgagctcaggtggcccctctcctctgaagtggtctgtttgttcttctgtcttcttcaacaagcttgccttccta

SEQ ID NO: 119465 - DNA, 395 bp, Homo sapiens
  Payload ID: 3406
  Gene Symbol: C9orf131
  Gene Name: chromosome 9 open reading frame 131
  ENST ID: ENST00000537671
  CDS Start-End: 352-395
gagaaaggtaaaaacaccttcaaataaggaagaggaacaggctatgacctaatgcttgcttggaccaatataagcatgccagggcaaatatttaggctaaattgtggaagctaagaacataaagtaaattgatttattacggctagcagatatttaagaatgttaacagaggtctttgaataaattttgcttctaagagatgttactatttattcctaataagatggagaggaaagtctttgaagaggaacctctactttactttttacatcctcaaaacaaccctgtgtaattcagagatggtggcagcttgggaggttgcgacagcttcatccctggtgctctgggaatatggtgcaaggcaaggaactaccacttctgcaccgtgtggcctt

SEQ ID NO: 119466 - DNA, 579 bp, Homo sapiens
  Payload ID: 3406
  Gene Symbol: C9orf131
  Gene Name: chromosome 9 open reading frame 131
  ENST ID: ENST00000534880
  CDS Start-End: 540-579
ggaatgctgagaaaggtaaaaacaccttcaaataaggaagaggaacaggctatgacctaatgcttgcttggaccaatataagcatgccagggcaaatatttaggctaaattgtggaagctaagaacataaagtaaattgatttattacggctagcagatatttaagaatgttaacagaggtctttgaataaattttgcttctaagagatgttactatttattcctaataagatggagaggaaagtctttgaagaggaacctctactttactttttacatcctcaaaacaaccctgtgtagaactaccacttctgcaccgtgtggccttccttgatcacctgtgtaagcagaaatcagaagtggaggaagaaggggaagaagaggaagagggggaagacgaggcatctctggatccactgaagccatgttctcctaccaaagaagctcccactggagagcaagccactccagccccaccccagccatcctgtggttctgagggcctcctcaaggctatagggataccagagcaaacagtcatgcagcccgtgagcccttccagatccttccccatcttcc

SEQ ID NO: 119467 - DNA, 873 bp, Homo sapiens
  Payload ID: 3407
  Gene Symbol: C9orf135
  Gene Name: chromosome 9 open reading frame 135
  Uniprot ID: Q5VTT2
  ENST ID: ENST00000377197
  CDS Start-End: 88-777
gagacgccgaatcttggtacttacgttcctgccgggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttctatcttaataaatgcaatggaagtgttactata

SEQ ID NO: 119468 - DNA, 748 bp, Homo sapiens
  Payload ID: 3407
  Gene Symbol: C9orf135
  Gene Name: chromosome 9 open reading frame 135
  Uniprot ID: Q5VTT2
  ENST ID: ENST00000527647
  CDS Start-End: 54-533
ggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttc

SEQ ID NO: 119469 - DNA, 550 bp, Homo sapiens
  Payload ID: 3407
  Gene Symbol: C9orf135
  Gene Name: chromosome 9 open reading frame 135
  ENST ID: ENST00000480564
  CDS Start-End: 1-448
ggagcgcaagggctccctgaccctccgctcccatcacaagaaatactcgaagccggtgttggtgtattcctggcaccgtgacagagaagcttttcccaaaggttatgatatagagggtcctgagaaagttaaaaaactgtgtaattcaacatatcggcgactgggaaccgatgaatccccaatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaa

SEQ ID NO: 119470 - DNA, 502 bp, Homo sapiens
  Payload ID: 3407
  Gene Symbol: C9orf135
  Gene Name: chromosome 9 open reading frame 135
  ENST ID: ENST00000495399
  CDS Start-End: 1-113
ggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgttagtagtccctaaactgctacaactgtacaaaatgtttcttgattcagaaggtttgtttgcaggggcaaaggtatgacagggtgagccaaggtcaacaaaatgccctttacatgacatcttcgacttgcctttaaccaaatgttttctcctttcacatgcacaacattaataaccgtaataataaaacagtaaatcctca

SEQ ID NO: 119471 - DNA, 697 bp, Homo sapiens
  Payload ID: 3407
  Gene Symbol: C9orf135
  Gene Name: chromosome 9 open reading frame 135
  ENST ID: ENST00000529446
  CDS Start-End: 54-206
ggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatgattttc

SEQ ID NO: 119472 - DNA, 825 bp, Homo sapiens
  Payload ID: 3407
  Gene Symbol: C9orf135
  Gene Name: chromosome 9 open reading frame 135
  ENST ID: ENST00000529131
  CDS Start-End: 53-205
gcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcccatcacaagaaatactcgaagccggtgttggtgtattcctgatttggacatcagaaacacatgaaaagttgtcacaaatgtgtttaaacacagaatgggttgaaatgaagagcaaggctttattgaatgaggaaacagtgagctccgggattatcgaaagggtcaccggattgcctgccacaggttttggagctgtctttcctagacatccaccggattggagcaaaatgtgtgcattgacaacgtactcagaagattatgttccaccatatgattatcagccacatgttcttccctatcttcctcctcttcatttcaactcttctctaagccttcatagcaaaggatattttctctacccatttggagaactctataatctcccaggtttgatcattgacattctaaagtcctcaaaactgcttatccctgtcaagatgattattccatagtccacagaaaatgccgttctcagttcacggatctaaatggttctaaaagatttggcatcaacacttggcatgatgagagtgggatttatgctaattcagatgtaaaacagaaactctatcccttgactagtgggcctattgtgccaatttaaaaataatgtatagaatcagcatctctgactaatgaaaaatggatgtagcagttgatga

SEQ ID NO: 119473 - DNA, 812 bp, Homo sapiens
  Payload ID: 3408
  Gene Symbol: C9orf142
  Gene Name: chromosome 9 open reading frame 142
  Uniprot ID: Q9BUH6
  ENST ID: ENST00000371620
  CDS Start-End: 27-641
cgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctacgtgaccgacgccgcggagctttggagcacctgcttcacgccggacagcctggcggccctcaaagcccgttttggcctgagtgcggctgaggacatcaccccccggttcagggcagcctgtgagcagcaagctgtggctctgactctgcaggaggacagagcatccctgacgctttcaggggggccctcggcactggcctttgacctctccaaggtaccaggcccagaggcagcccccaggctgcgggcgctgacactgggcctggcaaaacgcgtgtggagcctggagcggcgactggcagctgcagaagagacagctgtcagcccgaggaagagcccccggcctgcagggcctcagctcttcttaccagacccagatccccagagaggtggccctggacctggagtcaggaggcggtgtccaggagagtcgctcatcaaccccgggttcaagagtaagaaaccagctggtggcgtggacttcgatgagacctgaaggtgcagcacaagcgtggccccgcggggagtccgcctatgaggggagaggcagtctttgaggcccccatcagagaccccccgccaccacctccacctgcctgtcctgggccaggactaacacggctcctcaaattccttccctgtcaaataaacagctcccttggttgga

SEQ ID NO: 119474 - DNA, 2717 bp, Homo sapiens
  Payload ID: 3409
  Gene Symbol: C9orf152
  Gene Name: chromosome 9 open reading frame 152
  Uniprot ID: Q5JTZ5
  ENST ID: ENST00000400613
  CDS Start-End: 611-1330
cagagcgcgagcttagcactccccagccccagtcccagctctgccaggaaaggggagacttcaccgtggcactgggaattggattctaaactttaggatcaagcaatggaaggacctggaataagacaccttcttgacccccctgaagggctctgagcagctgggcttgcctttctctttgctcccccagtcctccccttacttctcggtctcccactccccatcactcctttccctgcctcctcctgcctgtctccatcttcctccctctctttcttctctcgccccattaatccccgcttgtcactatcacctccttcctccagtctttcccccttcgctgccccttctttcctctgacatttccttctcctcttactgccactgtctcccacctttctcctcccccacatttctccctatccctacctcctcttccccttcatctttctccttcccccttatttttctatctccttcctcagtcccactcctctttccaccctccttttgcccgtcacttctccttctccctcactgccccctccctctctctcccctccccaggtcctgccccacccagctgtgtttgcttttctcccggatccggatggaggggttgccctgcccgtgcccagccctgccccacttctggcagcttaggtctcacttaatggctgagggctccaggactcaggcccctgggaaagggcccccactcagcatccagttcctgcgagcccagtatgaaggcttgaagaggcagcagaggacccaggcccacctcctggtgcttccaaaaggaggaaacacacctgctcctgcagaatcgatggtcaatgctgtttggattaacaaggagagaagaagctcactgtccctggaagaggcagattctgaggtggaggggaggctggaggaggctgcccagggctgccttcaggcccccaagtctccatggcacacgcacctggagatgcattgtttggtccaaacctccccccaggacaccagtcatcaagtacatcataggggcaagcttgtgggatctgatcaaaggctccctcctgaaggagacacacacttgtttgaaaccaatcagatgactcagcaaggaaccggaatcccagaggctgcccagcttccatgccaggtgggcaatacccaaacaaaggcagtggaatctggcttaaaattcagcactcaatgtcctctttccataaagaacccacacaggtctggcaaaccagcttactatccatttccccagaggaaaacacccaggatctcccaagctgcccggaacctgggcttatatggctcagcgtgaagctttctattctgccagatgtcttgaccttgaggccacctatggccttatagaagaaccaaggaggcagagccacaacgaggtctctagctatgagcaagaactggactaacctaattataggaattgtgggagacgaacttcacaatggtaacatggttttacccttccaataagaagagacttcccaggccaaattgcccacagtttaggatgaagaggactgtctggtcagtgcagccccattctgacattactatgaggtcctggatatccattccttggggaggaccagtaagacatctgctccatccctggaactggataattttggaacataaaccagggacctagccaacagaatgccttagcaatgcccaggggtcaatgggcgtggcattcttgttttcaatgtcttctgatgatttctcatatattctggagaagacaagctctgagaattcagatgctttttctggtggctatgtctggggggccatctcacttagaagtcacaacactcattggcagtgatcacatcatttcaatttgggcttcccaaagtatggtcacccagggtatgaaggtgagatcaatgctacctaccattttgtgtctttaaggggtctttagaaagggctaatcatctgtcactgctcactgagacatgtacattccagcatcatcacagagttatctccttccttccttccttccttccttccttccttccttctgtctctccctccctccctcccttcctcccttctttccttctttctttcctctcttccttcttgccttctttcctgccttcctgcctatcttttctctctctctctctctgcaaattaagttcttattaaaaactgccaatcattgacgatatataatgatgagatcctgaacaaaagaggcaaagaaatgctcctacttgaaaaatacacattccctatagactgcctcctgtttagtccaacttagatcactcagatccttcctgggatcaaatatatttttaaacctaagacaaagcgaagcaggtgtcacttgggtgatagggaaaaaagcttgtatttcctggttaatgtttagcttttgtaatgctatttaaacacacctaaggtgcctttccctcatctcaggtgctttctctgtaaagtttcactcccacctttcttttctctgcatggccgtccagtcttgcccatctacatccagagctgttaactagtagtgtcattacctgtgaaaaacatgtagaagcttccttgaaccacccagaaatccactcaaatttggggattgtcattccttttgtgaataattaatacaattcagttgttttttaaatattctaataaaaaaggaaattttctcaaaaaaa

SEQ ID NO: 119475 - DNA, 1845 bp, Homo sapiens
  Payload ID: 3410
  Gene Symbol: C9orf153
  Gene Name: chromosome 9 open reading frame 153
  Uniprot ID: Q5TBE3
  ENST ID: ENST00000339137
  CDS Start-End: 135-422
ggggctgggccttggggctgctggatgaatgagacccagcctctgccctgggagtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtaaaattaagccgttaatacagagcaaaaggtccgatttaatctgctaacgtgagaagtggtttggacggtgcaacccatttggaccagggctaaagcaaatataggtcatatgaaaagaaaaggtgtaactgaagaacactcaagcaagcatagctttttaaggaattttaagcacacaaggaagttcatcatcataaagtatttggtacattcaacaaacaaattaacatctgagcatatagagatcaatatgagaacttaaatataatctattaactgtccagtgacaaagaaggaaacagcatccatgaaataagaacagaaagatttgtaaaagaacaaattggaaatcttggaaatgaaagatatagtcattgaaaattataataataacccttgataattatcccagtggtagcctggatatatctgaagagagagggctaacaagttggaagacagcattgaaaagcttagagatcatagcactgtaagacagaaaaataagagtattggacggtagaatgagaagttcagaaatgtatacgatggaattagcagaaaaaaaataggagaatggaaattaagtgatatgtgaaaataaaatgacagaaaaatctcaagaaacacatgagaccttgaactgaaaaatctcagactgattagcaagatattgaaaataaatctatacccagaaatactgtagcaaaactatggaccactaagcagtaaaggaaaatataatctacgaaagagagatggattacatacaaagaaatgacaaattgacaatagaatgctcattaacaatagaggtcagaggacaatagtgtcatatacttacaatgctgaaggaaaatagctgtctgtaattctataagcagccaaactctctctgaggagtagggggtaaaataaaaatgttaaaaaatacatgggcctaaaaatgtttactatccataatcccttgcttaaaaaaaactactaataaagtatgtattttagtaagaacccagagggaatgcaagaaataatggcaagcaaattgttaacaatatatgtgtgtatgattgtgtagatattaaaatacatttccgga

SEQ ID NO: 119476 - DNA, 409 bp, Homo sapiens
  Payload ID: 3410
  Gene Symbol: C9orf153
  Gene Name: chromosome 9 open reading frame 153
  Uniprot ID: Q5TBE3
  ENST ID: ENST00000376001
  CDS Start-End: 82-387
gtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcagtgtcaataaaatgaacaagcctggaaaacatagaaagaccccatctccaaaaataaataaataaataaataaataaataaaaatta

SEQ ID NO: 119477 - DNA, 1738 bp, Homo sapiens
  Payload ID: 3410
  Gene Symbol: C9orf153
  Gene Name: chromosome 9 open reading frame 153
  Uniprot ID: Q5TBE3
  ENST ID: ENST00000613665
  CDS Start-End: 28-315
ggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtaaaattaagccgttaatacagagcaaaaggtccgatttaatctgctaacgtgagaagtggtttggacggtgcaacccatttggaccagggctaaagcaaatataggtcatatgaaaagaaaaggtgtaactgaagaacactcaagcaagcatagctttttaaggaattttaagcacacaaggaagttcatcatcataaagtatttggtacattcaacaaacaaattaacatctgagcatatagagatcaatatgagaacttaaatataatctattaactgtccagtgacaaagaaggaaacagcatccatgaaataagaacagaaagatttgtaaaagaacaaattggaaatcttggaaatgaaagatatagtcattgaaaattataataataacccttgataattatcccagtggtagcctggatatatctgaagagagagggctaacaagttggaagacagcattgaaaagcttagagatcatagcactgtaagacagaaaaataagagtattggacggtagaatgagaagttcagaaatgtatacgatggaattagcagaaaaaaaataggagaatggaaattaagtgatatgtgaaaataaaatgacagaaaaatctcaagaaacacatgagaccttgaactgaaaaatctcagactgattagcaagatattgaaaataaatctatacccagaaatactgtagcaaaactatggaccactaagcagtaaaggaaaatataatctacgaaagagagatggattacatacaaagaaatgacaaattgacaatagaatgctcattaacaatagaggtcagaggacaatagtgtcatatacttacaatgctgaaggaaaatagctgtctgtaattctataagcagccaaactctctctgaggagtagggggtaaaataaaaatgttaaaaaatacatgggcctaaaaatgtttactatccataatcccttgcttaaaaaaaactactaataaagtatgtattttagtaagaacccagagggaatgcaagaaataatggcaagcaaattgttaacaatatatgtgtgtatgattgtgtagatattaaaatacatttccgga

SEQ ID NO: 119478 - DNA, 333 bp, Homo sapiens
  Payload ID: 3410
  Gene Symbol: C9orf153
  Gene Name: chromosome 9 open reading frame 153
  Uniprot ID: Q5TBE3
  ENST ID: ENST00000617985
  CDS Start-End: 28-333
ggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcagtgtcaataaaatgaacaagcctggaaaacatagaaagaccccatctccaaaaataaataaataa

SEQ ID NO: 119479 - DNA, 713 bp, Homo sapiens
  Payload ID: 3411
  Gene Symbol: C9orf16
  Gene Name: chromosome 9 open reading frame 16
  Uniprot ID: Q9BUW7
  ENST ID: ENST00000372994
  CDS Start-End: 149-400
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaccgc

SEQ ID NO: 119480 - DNA, 4387 bp, Homo sapiens
  Payload ID: 3412
  Gene Symbol: C9orf172
  Gene Name: chromosome 9 open reading frame 172
  Uniprot ID: C9J069
  ENST ID: ENST00000436881
  CDS Start-End: 1-2931
atgacccgtacggaccctccggacctgctggtgtcgaccgtgtaccaggacatcaaggtggcgaccccgggacccgcgtccaagtgctcgccatgtgagcgatccgtggcccggcctgctgagcccgcgcctttcaacaagcgccactgccgcagcttcgacttcctggaggcgctggacgggccggccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggccgcgcactgggcccgccccgccccgcagttccacggcctcacggtgcccgggccccgccacatggcgctgtcgcgcaccccgacgcccagcgactcatactgtgcggatccccgggcgttctactgcgacgggcccctgcctgggccccgggactacgccgagcgccgcagtctgcccttcaccaccccgccgggccccacccagttcttctatacagaggagccccaaggcttccggggcagctttgcagccagtcccggcccaaccttcgacgcctactaccccaggccctatccgtccgaggagctctcggggcccagtccaaggcgcatgggcggctactacgcaggagaggtgcgcaccttcccaatccaggaaccgccctcccgctcctactatggggaggctccacgagcctacggcctgccctacgggccccgctatgtccccgaggagccccgggcccactccaccgcccgccccttttacacggaggacttcggaaggtaccgcgagcgtgacgtcctggctcggacgtacccgcacccgcgcagcagcccggcctgggcggactggggcccgcgaccgtaccgcaccctgcaagtggtgccgccctctgaccccgacccgttgctcgcctcctggcacggcggcaccggcaccagtccgccccggctggccaccgacagccgccactactcgcgctcctgggacaacattctggccccggggccgcgccgagaagacccgttgggccgcggccgcagctacgagaacctgctggggcgcgaggtgcgggagccgcgaggcgtgtcccccgaaggccggcgcccgcccgtcgtcgtgaacctgtccacctctcccagacgctacgccgcactgtccctgtccgagacgtcgctgacggagaagggccgcgcgggcgagggcctgggccgcaactggtacgtgacgcccgagatcaccatcactgacaatgacctgcgcgccaccgagcgcccgagcgccagggcctgggagttgcccgggggccgcacgcggccacctccccacgcggcccccgacggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaacccagcgccgacgaggacgacctgatgacctgctccaatgcgcgctgccggcgcaccgagaccatgttcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcgcggagccgcgagcccgacatggagacgctgatcctgacgccaccgccgggcacggcgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgcgcgcgctcgactgggtggccagcgccaacctgctggacgacatcatgtgaggcgccgggcccaccaggcctagcccaggcgctggcccgaaccctgccctgcccactcaggccccgcccggcccacccagggccgcccccgagccccgccagggccccaccccgacttcttctaggccccgcctctaattccccagccttccaagctccgctcagttcggcctccagctccgcccaggcccccaccccccggcccttcgtccccgtagtgttcctcacaggcccttcgccttcccacccccagcaacccctctccctcctccgggcctcctccctctcccagctcgccctcgaggatccccagaagaagtcggtcctcgccctcggtgctccccgctgggaggcggggtgggcctgaggaccgccgagctctgccttcactcggaggggtcactactgcacagaccccacccgtagagatccggtccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgta

SEQ ID NO: 119481 - DNA, 1207 bp, Homo sapiens
  Payload ID: 3413
  Gene Symbol: C9orf173
  Gene Name: chromosome 9 open reading frame 173
  Uniprot ID: Q8N7X2
  ENST ID: ENST00000388931
  CDS Start-End: 27-1187
ttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggcccgccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccga

SEQ ID NO: 119482 - DNA, 1191 bp, Homo sapiens
  Payload ID: 3413
  Gene Symbol: C9orf173
  Gene Name: chromosome 9 open reading frame 173
  Uniprot ID: Q8N7X2
  ENST ID: ENST00000412566
  CDS Start-End: 27-953
ttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggcccgccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccga

SEQ ID NO: 119483 - DNA, 1015 bp, Homo sapiens
  Payload ID: 3413
  Gene Symbol: C9orf173
  Gene Name: chromosome 9 open reading frame 173
  Uniprot ID: Q8N7X2
  ENST ID: ENST00000611378
  CDS Start-End: 2-997
gatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaaggcctctttgcaggcacctggcaagagatgccctggccccaacacctacaatatccttcctgggagccgcctgcagagcccccgctcgccggccttctcgatgagccgctcccctgcgttcacctcctggctcagcacctccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttccc

SEQ ID NO: 119484 - DNA, 1012 bp, Homo sapiens
  Payload ID: 3413
  Gene Symbol: C9orf173
  Gene Name: chromosome 9 open reading frame 173
  ENST ID: ENST00000622761
  CDS Start-End: 1-252
aaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactatagggcggtggccgcagggcatggcagactttgtggttccagagcgaaagccccttcacgcagaaagctgacttcgaccaagagcaaaagtggccctcgccagcccactaccagctgctcagccggcccgccttccccgccttcagcttcagaggctgccactccgcttccaagacacctgaaggccacacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggccttctcgatgagccgctcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccga

SEQ ID NO: 119485 - DNA, 1025 bp, Homo sapiens
  Payload ID: 3413
  Gene Symbol: C9orf173
  Gene Name: chromosome 9 open reading frame 173
  ENST ID: ENST00000620243
  CDS Start-End: 27-788
ttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccaggtaccaggtgccgagcccgtccgtacgagagtcctccccacacccccactacagcatcggctgcaagcaccagggccgagagggcggtggccgcagggcatggcagactttgtggttccagagcgaaagccccttcacgcagaaagctgacttcgaccaagagcaaaaggcctctttgcaggcacctggcaagagatgccctggccccaacacctacaatatccttcctgggagccgcctgcagagcccccgctcgccggccttctcgatgagccgctcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccg

SEQ ID NO: 119486 - DNA, 948 bp, Homo sapiens
  Payload ID: 3413
  Gene Symbol: C9orf173
  Gene Name: chromosome 9 open reading frame 173
  ENST ID: ENST00000620716
  CDS Start-End: 26-418
tggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccccctgatcacagctgacctggaagtccccagccccaccagagggcggtggccgcagggcatggcagactttgtggttccagagcgaaagccccttcacgcagaaagctgacttcgaccaagagcaaaaggcacctggcaagagatgccctggccccaacacctacaatatccttcctgggagccgcctgcagagcccccgctcgccggccttctcgatgagccgctcccctgcgttcacctcctggctcagcacctccttctctttcggcagcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttcccaggcctcccctgggacttggggccccagcctggccttctgaccctctgggcaccccgatgcacccttctggctggccaacccttctatgggctgtggacaaggctggcccagcctggatcccccatctgcccatctccccgctacactgagatgctgttggttttcccg

SEQ ID NO: 119487 - DNA, 1151 bp, Homo sapiens
  Payload ID: 3414
  Gene Symbol: C9orf24
  Gene Name: chromosome 9 open reading frame 24
  Uniprot ID: Q8NCR6
  ENST ID: ENST00000297623
  CDS Start-End: 200-988
ggagggggcatcagtgtggggtgggagcaggaaggctgttggggaaggaagctgagagatcctctgcaggaggggattatagcagctaagggcacctgccaggctggaggtgtggcctgtctaggggaagggtggtcactgatgtccagcaggagcccttgacaggtagagcccaccacggcatctccaagaccacaccatgttcctgttctcccgtaagaccaggacccctatcagtacctacagtgactcctacagggctcccacctccatcaaggaggtctataaggacccacccctgtgtgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 119488 - DNA, 648 bp, Homo sapiens
  Payload ID: 3414
  Gene Symbol: C9orf24
  Gene Name: chromosome 9 open reading frame 24
  Uniprot ID: Q8NCR6
  ENST ID: ENST00000379124
  CDS Start-End: 97-591
cgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactgtaagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 119489 - DNA, 496 bp, Homo sapiens
  Payload ID: 3414
  Gene Symbol: C9orf24
  Gene Name: chromosome 9 open reading frame 24
  Uniprot ID: Q8NCR6
  ENST ID: ENST00000379126
  CDS Start-End: 104-439
ggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcggatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 119490 - DNA, 596 bp, Homo sapiens
  Payload ID: 3414
  Gene Symbol: C9orf24
  Gene Name: chromosome 9 open reading frame 24
  Uniprot ID: Q8NCR6
  ENST ID: ENST00000379127
  CDS Start-End: 45-539
gctgaagggcgggagaagttgcggcgtggcgataggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactgtaagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 119491 - DNA, 712 bp, Homo sapiens
  Payload ID: 3414
  Gene Symbol: C9orf24
  Gene Name: chromosome 9 open reading frame 24
  Uniprot ID: Q8NCR6
  ENST ID: ENST00000379133
  CDS Start-End: 166-549
tgacagccgccaacacagagccctggagaggtggggagctgctgaagggcgggagaagttgcggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 119492 - DNA, 376 bp, Homo sapiens
  Payload ID: 3414
  Gene Symbol: C9orf24
  Gene Name: chromosome 9 open reading frame 24
  ENST ID: ENST00000444429
  CDS Start-End: 1-376
tgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggtatctgttgcacccagcacagacgtctggggactgggacacgcataccccaccacctcccaaactacagtgactgatatttca

SEQ ID NO: 119493 - DNA, 1966 bp, Homo sapiens
  Payload ID: 3415
  Gene Symbol: C9orf3
  Gene Name: chromosome 9 open reading frame 3
  Uniprot ID: Q8N6M6
  ENST ID: ENST00000277198
  CDS Start-End: 187-1887
agtaaccccgagtctgcggaagtggtgacccgtgggacgcggctgagacaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaaggtttccacatgttggcggatgcagtggaagcttctcttgagatctttgccacactgttcaacatgtttgaccactctgtcctaaaaacgctttcttcttaaagcactttctcctcctgg

SEQ ID NO: 119494 - DNA, 2820 bp, Homo sapiens
  Payload ID: 3415
  Gene Symbol: C9orf3
  Gene Name: chromosome 9 open reading frame 3
  Uniprot ID: Q8N6M6
  ENST ID: ENST00000297979
  CDS Start-End: 176-2338
gtctgcggaagtggtgacccgtgggacgcggctgagacaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 119495 - DNA, 3136 bp, Homo sapiens
  Payload ID: 3415
  Gene Symbol: C9orf3
  Gene Name: chromosome 9 open reading frame 3
  Uniprot ID: Q8N6M6
  ENST ID: ENST00000375315
  CDS Start-End: 136-2595
gagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgtatacgtgtttgcttctaaatttcatactgtttaaaaataataaaggccaggtgcggtggc

SEQ ID NO: 119496 - DNA, 704 bp, Homo sapiens
  Payload ID: 3415
  Gene Symbol: C9orf3
  Gene Name: chromosome 9 open reading frame 3
  ENST ID: ENST00000427193
  CDS Start-End: 1-423
agctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggtaagaaaataaaatgactggaagcttctagataaatctgtatctcaagtgagaaagagaatgactttttttgaatttgatcttcacgtcacttactgtatgcaaagctttcaagtatatttaaaacataaatttattatgttagctttcaataaatttctttttttaaattagacaaatataagaaaatctgtaaattggtaccttttcttttaagttccattagtggcttccccatttcccacctgtactgtatcccagctgagaataaaacttgtatcaaaa

SEQ ID NO: 119497 - DNA, 2288 bp, Homo sapiens
  Payload ID: 3415
  Gene Symbol: C9orf3
  Gene Name: chromosome 9 open reading frame 3
  ENST ID: ENST00000428313
  CDS Start-End: 1-1806
ctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgta

SEQ ID NO: 119498 - DNA, 1605 bp, Homo sapiens
  Payload ID: 3415
  Gene Symbol: C9orf3
  Gene Name: chromosome 9 open reading frame 3
  ENST ID: ENST00000424143
  CDS Start-End: 1-1527
gttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagacccagtaaagacaaaactggccacacaagtgactcgggagcatctgttatcaagcatggacttaatccggagaagatcttcatgcaggtgcattatttaaagggctacttccttcttcggtttcttgccaaaagacttggagatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggtaggtgtcatctttcagcagatggggattctgtaaaggctgtccctgcacttcacacaggaatccacgttctcagtatctctttcataacaaataattaaatctgttacagag

SEQ ID NO: 119499 - DNA, 514 bp, Homo sapiens
  Payload ID: 3415
  Gene Symbol: C9orf3
  Gene Name: chromosome 9 open reading frame 3
  ENST ID: ENST00000451893
  CDS Start-End: 1-436
agatgaaacctatttttcatttttaagaaaatttgtgcacacatttcatggacagctgattctttcccaggatttccttcaaatgctactggagaacattccagaagaaaaaaggcttgagctgtctgttgaaaacatctaccaagactggcttgagagttccggaataccaaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttagaatttcagtatgttactttgcagaagtttggactgcctgtcttttgattttgtattaaaacttgatttgtcattgtaa

SEQ ID NO: 119500 - DNA, 873 bp, Homo sapiens
  Payload ID: 3415
  Gene Symbol: C9orf3
  Gene Name: chromosome 9 open reading frame 3
  ENST ID: ENST00000445181
  CDS Start-End: 1-553
tgcggaccccgggcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtggggg

SEQ ID NO: 119501 - DNA, 895 bp, Homo sapiens
  Payload ID: 3415
  Gene Symbol: C9orf3
  Gene Name: chromosome 9 open reading frame 3
  ENST ID: ENST00000478473
  CDS Start-End: 1-541
gcgggcgcagggcgcgggctccggcgccgccgctgcgtcctccccggccgcgggcgagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtccc

SEQ ID NO: 119502 - DNA, 2327 bp, Homo sapiens
  Payload ID: 3416
  Gene Symbol: C9orf40
  Gene Name: chromosome 9 open reading frame 40
  Uniprot ID: Q8IXQ3
  ENST ID: ENST00000376854
  CDS Start-End: 276-860
aggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggggggcggtggcgacgacggggcggggcgcgcaggacccccgcggggagactggggggtcgcatcgcgccagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaagtgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattccttattactttagacctgtagttttcaacactgacagcactttaaaaatctttgcctgggcctcactcttgagagattctcatttaatagttctgaggtgggtcttggatataactatttttttaaacacctgtcctgtttccctccattcctctcatgtgcagacagggttgagaaccagtagactaatggtcgtttttcctgtttaaaggagataactaatttgagctgaagcaatgcttcttaattagctttgtttttgttttgctctgttggtggctttgttacaactgaattattgtgttattactatttcattgttaaagaaataaagtaagcaatttgtgatgtgagtatcagtgattaagttaactaacttttgtactgcatccagaatgttggttttgcaattgagtaactggttcttgcttgcattttttgttgttgatgacattagatccaaaattcaagacaaatggtaaatgccattgagagggaaagagaaaaacttgattttttttgtgtaatgaaggatttaagaatgggttgacattaataagaatgctttagaacagaagacaaactgtattgcattgtggtcagacatggttcaaagtcttgtactgccacttcctacctatgtatctttaagccagttatttttcatctccaagcctcaaatttctcacctgtaaaatgagaaataataaatagtatctacctcaga

SEQ ID NO: 119503 - DNA, 2130 bp, Homo sapiens
  Payload ID: 3417
  Gene Symbol: C9orf43
  Gene Name: chromosome 9 open reading frame 43
  Uniprot ID: Q8TAL5
  ENST ID: ENST00000288462
  CDS Start-End: 447-1832
cctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatggtactaagactgagtgttatttagattttattgttgttgtttgtgtttaacgcgaactatttaggcagcccagggataatgctggccatatagagatgcgcctgattaggtctcaggagtcaattcggactgggcagagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtattgtggatcccagaagaaacagagatacatgtgagccagcatgggaagaagaaaagaaagaactcggcagtgaaaagcaagtcatttctgggtctctctggaaatcagtccgcaggaacacgagtaggaacaccagggatgatcgtgcctcccccaaccccagtgcaattgtctgaacaattcagttcagatttcctacctctctgggctcaatccgaagcgttacctcaggatctactgaaggaacttttgccaggtggaaagcaaaccatgctctgtccagagatgaagataaaattggccatgatgaaaaagaatcttcccttggaaaagaaccgacctgacagtgtgatttcttctaagatgtttctatctatacaccgcctcaccctggaaagaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaatccccagcctttttaaatttagattatttcctttccattagggtcagaataattttggtgattaaacacaactgcttttcaa

SEQ ID NO: 119504 - DNA, 2049 bp, Homo sapiens
  Payload ID: 3417
  Gene Symbol: C9orf43
  Gene Name: chromosome 9 open reading frame 43
  Uniprot ID: Q8TAL5
  ENST ID: ENST00000374165
  CDS Start-End: 366-1751
gcggccgggcgcagcgcgtgggagacgaaggcgtggctgactcggcggggcggatccctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatgagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtattgtggatcccagaagaaacagagatacatgtgagccagcatgggaagaagaaaagaaagaactcggcagtgaaaagcaagtcatttctgggtctctctggaaatcagtccgcaggaacacgagtaggaacaccagggatgatcgtgcctcccccaaccccagtgcaattgtctgaacaattcagttcagatttcctacctctctgggctcaatccgaagcgttacctcaggatctactgaaggaacttttgccaggtggaaagcaaaccatgctctgtccagagatgaagataaaattggccatgatgaaaaagaatcttcccttggaaaagaaccgacctgacagtgtgatttcttctaagatgtttctatctatacaccgcctcaccctggaaagaccagcactgcgatatcctgaacgtttgaagaaattacataacctgaagacagaaggttacaggaaacagcagcagcggcagcagcagcagcagcagcaacagaagaaggtgaaaacacctattaagaaacaggaggctaaaaagaaagccaagagtgatccagggatccagagcacttcacataaacatccagttaccaccgttcatgaccgtctctatggttacagaactctgccaggtcagaacagtgacatgaagcagcagcagcagatggaaaaaggaaccacttcgaaacaggattccacggagagaccaaagatgaactactatgaccatgcggatttccaccacagtgtaaaaagtcctgaattgtatgaaacagaacccactaacaaggacattagtgctccagtggacgctgtgccagaagcccaggctgccaggcaaaagaagatctcctttaacttttcagaaattatggctagcacaggctggaactctgagctcaaactacttaggattcttcaggacactgatgatgaggatgaggaggaccagtcctctggggcagagtgagaagcctctggaggaatagactgaaggcatcccctggggcagccgtgttccaaagcgggatggctggtatcctgagggcagcaacgtttcacataagggcaagaggagaggggcttctgctctctggagcctttaccagggcctgagctctgagcttagggattccattttctttgttcacctctacttgcctctaaaataaatgtaggagaaaaatccccagcctttttaaatttagattatttcctttccattagggtcagaataattttggtgattaaacacaactgcttttcaa

SEQ ID NO: 119505 - DNA, 4829 bp, Homo sapiens
  Payload ID: 3418
  Gene Symbol: C9orf47
  Gene Name: chromosome 9 open reading frame 47
  Uniprot ID: Q6ZRZ4
  ENST ID: ENST00000334490
  CDS Start-End: 69-677
aaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattgaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgtgcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctctgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacatgtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgaggatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacact

SEQ ID NO: 119506 - DNA, 859 bp, Homo sapiens
  Payload ID: 3418
  Gene Symbol: C9orf47
  Gene Name: chromosome 9 open reading frame 47
  ENST ID: ENST00000375850
  CDS Start-End: 76-783
cccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaa

SEQ ID NO: 119507 - DNA, 4837 bp, Homo sapiens
  Payload ID: 3418
  Gene Symbol: C9orf47
  Gene Name: chromosome 9 open reading frame 47
  Uniprot ID: Q6ZRZ4
  ENST ID: ENST00000375851
  CDS Start-End: 134-685
agagcgcggagagggaccaggcaggcgccggaggggacccgcgcggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgtgcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctctgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacatgtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgaggatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacact

SEQ ID NO: 119508 - DNA, 1620 bp, Homo sapiens
  Payload ID: 3419
  Gene Symbol: C9orf50
  Gene Name: chromosome 9 open reading frame 50
  Uniprot ID: Q5SZB4
  ENST ID: ENST00000372478
  CDS Start-End: 203-1498
atttttcaggtgaggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgccttcctaggagagctcctccccagcaggttccgtgagttcctgcaccagctccaggagaagtgcgccgaggagccggagccactgacatccccagcaccgcaacatcaaaggggtgtattagagcactgcccagggtctccgcggtgtcccaactgttcattcctcccagacctgtggggccagtcatcgcacctccaggatagtcttacgaagatttcgctccagcagacacctattctggggcccctgaagggtgatcactcacaattcaccactgtcagaaaggccaaccacaggccccacggtgcacaggtccccaggctcaaggctgcgctgacccacaacccctcgggggaaggctctaggccctgcaggcagcgttgccctttccgggtgcgattcgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgctcagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggcacatcccaggtggctgggacctgccagtaggtgtcacaccacaa

SEQ ID NO: 119509 - DNA, 796 bp, Homo sapiens
  Payload ID: 3419
  Gene Symbol: C9orf50
  Gene Name: chromosome 9 open reading frame 50
  ENST ID: ENST00000619117
  CDS Start-End: 509-718
ctctcgcctgaagccactcgctgtccgccgggccggtggcgttcaccccgcaccgcgctgccccgcccggggcactatggcctggggctggactatgccctccccacctcagccggcgccccccacccacgcgcgctgagggccccacggtgcacaggtccccaggctcaaggctgcgctgacccacaacccctcgggggaaggctctaggccctgcaggcagcgttgccctttccgggtgcgattcgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgctcagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggc

SEQ ID NO: 119510 - DNA, 1502 bp, Homo sapiens
  Payload ID: 3420
  Gene Symbol: C9orf57
  Gene Name: chromosome 9 open reading frame 57
  Uniprot ID: Q5W0N0
  ENST ID: ENST00000377024
  CDS Start-End: 97-582
gctttcagttgtaacggacttcatcacatcacaaattgtactcgttctcatccttttaagaaagttcagacccaggaaaatttccatagtaccttaatgaaaaagatagaaatcagtgggacgtgtctttcctttcatctccttttcggcttggaaatcagaatgagaaggattgtttttgctggtgttatcttattccgcctcttaggtgttatcttattccgcctcttaggtgttatcttattcggccgcttaggtgacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccctttcaacaccatttctctcctctcctccttctgcttaatttaccttcctaccacaaggctacaaagaaggaaaaatgttagtgattctccaagtcaaactaggcatgtcacctctaactactttcatttccctcaataattccatactccaaaatatggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccaggcctgcgggaaaagtatgaacccaaacaggaaagggctgaggcaggtggtagggctggcacttatttcttccatctgcctcagagtttatccaaattttgaattttccgtaccttaaccatgcctaaatgctttggcttgttcaattttggcagattaagcagttcaaggtaagcagagaagtaagttcccaaccacaaggaatttaaaaggagtaggaacgtactttgaactacatttcccattttgcgatcattacgtcttctattacaatgccctactttggcagcatgaagagtactgcattaatttaatttaatttaaaatttaatttaaaactgtctttctctgtattttcaggagtttgaaaattcaaaaaataaataataaatgtcaataaaa

SEQ ID NO: 119511 - DNA, 1297 bp, Homo sapiens
  Payload ID: 3420
  Gene Symbol: C9orf57
  Gene Name: chromosome 9 open reading frame 57
  Uniprot ID: Q5W0N0
  ENST ID: ENST00000424431
  CDS Start-End: 1-384
atgggggtgggattcactgagctagaatacttggctccctggcttcggccccccttttcagacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccctttcaacaccatttctctcctctcctccttctgcttaatttaccttcctaccacaaggctacaaagaaggaaaaatgttagtgattctccaagtcaaactaggcatgtcacctctaactactttcatttccctcaataattccatactccaaaatatggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccaggcctgcgggaaaagtatgaacccaaacaggaaagggctgaggcaggtggtagggctggcacttatttcttccatctgcctcagagtttatccaaattttgaattttccgtaccttaaccatgcctaaatgctttggcttgttcaattttggcagattaagcagttcaaggtaagcagagaagtaagttcccaaccacaaggaatttaaaaggagtaggaacgtactttgaactacatttcccattttgcgatcattacgtcttctattacaatgccctactttggcagcatgaagagtactgcattaatttaatttaatttaaaatttaatttaaaactgtctttctctgtattttcaggagtttgaaaattcaaaaaataaataataaatgtc

SEQ ID NO: 119512 - DNA, 2067 bp, Homo sapiens
  Payload ID: 3421
  Gene Symbol: C9orf64
  Gene Name: chromosome 9 open reading frame 64
  ENST ID: ENST00000314700
  CDS Start-End: 268-870
aaaggagaggggtgggagcggggtgggggcatcgcgacccagggcaaggcggcgagtcgccgtcttcgagtcccacctgtccgaagcggggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcaaaaaaaaaaaattcctgacatcgctatgtattcccaactttatcatttgtctgcctgtttagttttgacttatgttttttttttttcccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttctt

SEQ ID NO: 119513 - DNA, 620 bp, Homo sapiens
  Payload ID: 3421
  Gene Symbol: C9orf64
  Gene Name: chromosome 9 open reading frame 64
  ENST ID: ENST00000376340
  CDS Start-End: 251-433
ggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgagtgtacttgaacaaatgatgatcattttgttggaccctcacaggctgcacccggattttgtttttgtaaaattcttttggaatcttttgaacctgggagggggaggttgcagtgagccgagattacgccaccgcactccagcctgggtgacagagctggactccatctcaaaaaaataaaagaaaaaataaaagaaa

SEQ ID NO: 119514 - DNA, 2443 bp, Homo sapiens
  Payload ID: 3421
  Gene Symbol: C9orf64
  Gene Name: chromosome 9 open reading frame 64
  Uniprot ID: Q5T6V5
  ENST ID: ENST00000376344
  CDS Start-End: 218-1243
cgagctgccccggggtctctctggtttcctaatcagggcaacgccgcgggagagaacctttaccttggctgcactaagttctcggtgccactccctggcagggcgggaccttgtttaggccctgtgatcgcgcggttcgtagtagcgcaaggcgcagagtggaccttgacccgcctagggcgggaagagtttggcccgccgggtcccaaagggcagaatggacgggctcctaaatcccagggaatcctctaaattcattgcagaaaacagtcgggatgtgtttattgacagcggaggcgtacggagggtggcagagctgctgctggccaaggcggcggggccagagctgcgcgtggaggggtggaaagcccttcatgagctgaaccccagggcggccgacgaggccgcggtcaactgggtgttcgtgacagacacgctcaacttctccttttggtcggagcaggacgagcacaagtgtgtggtgaggtacagagggaaaacatacagtgggtactggtccctgtgcgccgccgtcaacagagccctcgacgaagggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaaagtgagaatagtgcgcagaagttaatgcacctggtggttgaaagttttccttcttacagagatgtgactctgtttgaggggaaaagagtttctttttacaaacgagcccaaatccttgtagcagatacgtggagtgtattggaaggaaaaggagatggctgcttcaaggacatctccagtatcaccatgtttgctgattatagattacctcaggttcttgctcatcttggagccctgaaatactctgatgacctactgaagaagcttctcaaaggagaaatgctctcatatggagacaggcaagaggtggaaatcagagggtgctcgctttggtgtgttgagctgatccgggattgtcttctggagcttattgaacaaaagggtgaaaaacctaatggagagatcaattccattcttctggattattacttatgggactatgcccatgaccatagggaagatatgaaaggaattccgtttcatcgcatacgttgcatatattattgacctcaagtgtaaactgatccaaagaaaaccccctgcgttttatatcatatcatctgtacagttttgctttgatatttagagaacatgatcgaggttataggaaattgattgcccattctcacttgaaaaatacttcctaggccgggcacagtggtttatgcctgtaatcccagcactgtgggaggctgaggcgggtggatcatctgaggtcaggagtttgagaccacctggccaacatggtgaaaccccatctctactaaaaatacaaaattagctgggcgtggtggcacgtgcctgtaatcccagttacttgggaggctgaggcaagagaatcgcttgaactcagaaggtggaggttgcagtgaggcgagattaggccattgcactccagcctcagcaacaagagtgaaactttgtctcaaaaaacaacaacaacaacaacaacaacaacaaaacttcctaggccagatgtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggctgaggctgaggagggtggattgcttgagcccaggggtttgaggctgcagtgagccacagtcacgccactgcattctatcctgggcaacagatggagaccttgtctcaaaaaaaaaaaattcctgacatcgctatgtattcccaactttatcatttgtctgcctgtttagttttgacttatgttttttttttttcccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttcttaaa

SEQ ID NO: 119515 - DNA, 2918 bp, Homo sapiens
  Payload ID: 3422
  Gene Symbol: C9orf66
  Gene Name: chromosome 9 open reading frame 66
  Uniprot ID: Q5T8R8
  ENST ID: ENST00000382387
  CDS Start-End: 346-1233
aactttgattaggaattggatggtgagttgggatcccccagtccttagctttttgctggagttctgtaaatctcaaaatgtcagccacaggccatttcttttggtttatttaagtgtagattttttaaaaaatcactttttccacttcatggctcctttggaccagggtataaaaatagcgatgccaccaggagccaagctctttctggaataatgaagcaggcgaggacggagccttgctcaggacgacagaaggcttgcagcctgcctcaaacgcaactctaatttcagccacttcacttcttccccccgcgctcagacttgcctcaaaggaaggagccgtttatgagacactccgtggcgcgcccaacacggttacccaggcgcctatcacccttctgggacccggccacctgtaagaacctggagggcggagcgggcgaggttgttcggggaagggatccccggcggctgaggacatccaggagcaccgagattcttggggaggacctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcaacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctcccgatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaataaacattatgagttctcaaaaaatgttttcgtcacaacctggcgtgaatgcttttctccggagaaacactgaaggcggcgttcttgcgattcaagggtacgctgcgtccaggtttatttcagtttcagactgaggtctgctaagaagcccggcctcaaactcaagataaaaacagaaaagtcccagtgttgacgggagtggaggagcccgtgttcgcttcaaggtgccggcgtgctgctctaacctgtgctatatatactcgagcactctccatataatgcctccatttaccaacttgctcttaaaaaataccaaagcaggccgggcgcggtggctcacgcctgtgatcccagcactttgggaggccgaggcgggcgcatcacgaggtcaggagatcgagaccatcctggccaacgtggtgaaaccccgtctctactaaaatacaaaaaattagccgggcgtggtggcgcacgccttagtcccagctacttgggaggctgaggcaggggaatcacttgaacccgggaggcggagcttgcagtgaaccgagatctgccactgcactccagcctggcgacagagcaagtctccgtctaaaagaaaaaaaaaaaaacaaccaaagcgaagtatttttggttcaaacctgcactatttaatatgatagccactagccacatgtggctattgaccactcggcattatggttagtctgaattgcccactgctggatgtgtaaaatgtacactggaatttaaagacagcgcagaaaacatcgtgtaaaatgtcttgttaatgattttcatgttgattgcatgttaaatgatactttggatataaaaaatatattattaaagttaatttcacctgtttgttttccccttttaaaaatgtggtttgcatttttaaaaatgtaaaattacacatgtggctcacatttgtgagcctcattatattcctattggacagtgccagtccaatacaacctaatttgtcacctaatactaaaatccacctaaggactatattcagtctcttcctgatacagccttccttcctggtttcagctgtgtcaggtagtttagtaacttttcagtactggttaggtaactccccgccccccaatgcccaccaaatatcagtgcccttttaagcatataagacaaagttcactgcatagactacaatagactacatacgaaaacaaacccaaagaaaaataaagcttttttgaaatttagagtttctgactttcaaaactgtccttatttactacattggaatttatgagcaaacatttggatagcaaaatacaaagagaacaaatgtgtaagtacttcttcaaactgagactcaacgaatgatacatagaaaacattttgccccagaggcttcggtccacggtgtaccatgtcagcctttcggatgaactcctctgaatttctgaatgtttatgacatacattttcatatagaacaaaaatatactggtttcacacaaacataaataaaatgtaatgaaagc

SEQ ID NO: 119516 - DNA, 2804 bp, Homo sapiens
  Payload ID: 3423
  Gene Symbol: C9orf69
  Gene Name: chromosome 9 open reading frame 69
  Uniprot ID: H0YL14
  ENST ID: ENST00000561457
  CDS Start-End: 485-904
gcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggccggggtcccggccggggcgagctccaggccaaggccggccttaaatagggccgctctggcccctgcaccccgtggaggagccgggcggagggagagggcgaggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttgatgga

SEQ ID NO: 119517 - DNA, 2823 bp, Homo sapiens
  Payload ID: 3423
  Gene Symbol: C9orf69
  Gene Name: chromosome 9 open reading frame 69
  Uniprot ID: H0YL14
  ENST ID: ENST00000418388
  CDS Start-End: 504-923
gggaagcgacgagtccgggacgcccagcgcgggcccggagcagggggaagggaagtgcggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttgatgga

SEQ ID NO: 119518 - DNA, 648 bp, Homo sapiens
  Payload ID: 3423
  Gene Symbol: C9orf69
  Gene Name: chromosome 9 open reading frame 69
  ENST ID: ENST00000447934
  CDS Start-End: 534-648
gggcgtctgcagaaacgcagggacccggatggagccgcgggccgcgagaccctgcggggacacagctccgccgagtcgcgtttgagtggcaccgccatggccggggtcccggccggggcgagctccaggccaaggccggccttaaatagggccgctctggcccctgcaccccgtggaggagccgggcggagggagagggcgaggtcgggcccctgcgggcacgggagggtcaggcggccccggcccctccctcctccgccctggccaggtccccacggcagggccccaggctgaatctgaaggcaggcgaagctcttggcaacagtcccctgtaatgttaccaactttcctgctcagattttatttcctgacctttgagttcattccgtctacagattatttcggcaaggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtaca

SEQ ID NO: 119519 - DNA, 1981 bp, Homo sapiens
  Payload ID: 3423
  Gene Symbol: C9orf69
  Gene Name: chromosome 9 open reading frame 69
  Uniprot ID: H0YL14
  ENST ID: ENST00000557985
  CDS Start-End: 175-594
ggccggccccgaggtccgggacgccggcgccgccgcggagagggcaccgggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtg

SEQ ID NO: 119520 - DNA, 588 bp, Homo sapiens
  Payload ID: 3423
  Gene Symbol: C9orf69
  Gene Name: chromosome 9 open reading frame 69
  ENST ID: ENST00000448040
  CDS Start-End: 492-588
gcaacgcgcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggccggggtcccggccggggcgagctccaggccaaggccggccttaaatagggccgctctggcccctgcaccccgtggaggagccgggcggagggagagggcgaggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacc

SEQ ID NO: 119521 - DNA, 777 bp, Homo sapiens
  Payload ID: 3424
  Gene Symbol: C9orf72
  Gene Name: chromosome 9 open reading frame 72
  Uniprot ID: Q96LT7
  ENST ID: ENST00000379995
  CDS Start-End: 77-745
tctcttttgggggcggggtctagcaagagcagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagc

SEQ ID NO: 119522 - DNA, 1873 bp, Homo sapiens
  Payload ID: 3424
  Gene Symbol: C9orf72
  Gene Name: chromosome 9 open reading frame 72
  Uniprot ID: Q96LT7
  ENST ID: ENST00000379997
  CDS Start-End: 125-793
acgtaacctacggtgtcccgctaggaaagagaggtgcgtcaaacagcgacaagttccgcccacgtaaaagatgacgcttgatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagaaaataacagactgtctacttagattgttctagggacattacgtatttgaactgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggc

SEQ ID NO: 119523 - DNA, 3200 bp, Homo sapiens
  Payload ID: 3424
  Gene Symbol: C9orf72
  Gene Name: chromosome 9 open reading frame 72
  Uniprot ID: Q96LT7
  ENST ID: ENST00000380003
  CDS Start-End: 65-1510
gcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaatttt

SEQ ID NO: 119524 - DNA, 3339 bp, Homo sapiens
  Payload ID: 3424
  Gene Symbol: C9orf72
  Gene Name: chromosome 9 open reading frame 72
  Uniprot ID: Q96LT7
  ENST ID: ENST00000619707
  CDS Start-End: 203-1648
acgtaacctacggtgtcccgctaggaaagagaggtgcgtcaaacagcgacaagttccgcccacgtaaaagatgacgcttggtgtgtcagccgtccctgctgcccggttgcttctcttttgggggcggggtctagcaagagcaggtgtgggtttaggagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttg

SEQ ID NO: 119525 - DNA, 1795 bp, Homo sapiens
  Payload ID: 3425
  Gene Symbol: C9orf78
  Gene Name: chromosome 9 open reading frame 78
  Uniprot ID: Q9NZ63
  ENST ID: ENST00000372447
  CDS Start-End: 55-924
agcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaaaaaaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatgaatccaa

SEQ ID NO: 119526 - DNA, 1792 bp, Homo sapiens
  Payload ID: 3425
  Gene Symbol: C9orf78
  Gene Name: chromosome 9 open reading frame 78
  ENST ID: ENST00000615599
  CDS Start-End: 286-813
ggaagcagcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcatacggagaaacaaagaagagcccaaggcccggcccttgagagtaggtgacacggagaagccagagcctgagcggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaaaaaaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaatcttgtttgtaaatatattgtctttctcttaatatttgctctgggtcaggaagaagctgttcacggtgtgataatactctttagattgtgctttcattattatagatgcatcatgtcttctgctttcacgtgtctgggatggggtcagaaatgcatcctccagctgacagaaaaatccaggatgagatcagaaggatactggtgttttctgacttttacaaaattacttgtttgttttcattaaaaaaaaagcataaactatgtttcttattactattagaattattaaatttcaaaatg

SEQ ID NO: 119527 - DNA, 4661 bp, Homo sapiens
  Payload ID: 3426
  Gene Symbol: C9orf84
  Gene Name: chromosome 9 open reading frame 84
  Uniprot ID: Q5VXU9
  ENST ID: ENST00000318737
  CDS Start-End: 130-4464
aaagaagaaagtgcttcaagaaggaagtagtagtccaatgtgttgggctcctgttaaaagctcaagttatgtgaggatagtgagttgaccattagcttgactaaattctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatc

SEQ ID NO: 119528 - DNA, 1973 bp, Homo sapiens
  Payload ID: 3426
  Gene Symbol: C9orf84
  Gene Name: chromosome 9 open reading frame 84
  Uniprot ID: Q5VXU9
  ENST ID: ENST00000374283
  CDS Start-End: 146-1612
ggggcctggtctggccaatggaagcacagagtgcaggctcagtggtcacgtgtccagcgggcgggaattttaccccaggaagagatgcaggaggcgatttttacctcagatgttgaaatttacactgctttgaaagaaagaagatatgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtgaaaatgttagattctggatttcctctaggtaattgggaaaatcactaggttctagcattccatataggccctggctctgccagaatttatgactttggatttctctaggtcccattttcttgaaaaaatgatgaagtttgactagctaaccctaaaatcttgttatgtcctaaaattctatagtctcagtttttaaatttctagccattttcatttaaagtgactttgtttccttttataaatgattaaattgctagcagtttccgttcacattggcctagacgcaaaccagcattttgcagtaactgttttttgacctaacagctgaacattagcattcaataatatcactctttaacaat

SEQ ID NO: 119529 - DNA, 4721 bp, Homo sapiens
  Payload ID: 3426
  Gene Symbol: C9orf84
  Gene Name: chromosome 9 open reading frame 84
  Uniprot ID: Q5VXU9
  ENST ID: ENST00000374287
  CDS Start-End: 136-4470
atttgtgaataaataaagataaaatcataatgtaaaaggtgaatgtttggcttccttgaattaagtgtaaaagaaaattctagacattaatgttaactattatcctttctagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcac

SEQ ID NO: 119530 - DNA, 4955 bp, Homo sapiens
  Payload ID: 3426
  Gene Symbol: C9orf84
  Gene Name: chromosome 9 open reading frame 84
  ENST ID: ENST00000394777
  CDS Start-End: 246-4358
agacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagagactctgggggatgaattggagatattaagaggtaaaatgatgcagagaagaccaaggtcagcagaagtcaaatacttctatttctttaaaattttgcttaggctacgcctggctattttgaagtatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcacacaggccatttaaatgagtctccatcacagtctgaccctttgagtcaggaagtgaagatcatcacagttaaccctcccacatcaagaaagttaaaacctaggacaaaattgaagttagaaaacttccaacttaaagtatcattttctgtaaacacaatttaagaacaaattactaagaggaaatatttgcaacccagataataggaaaaaaagtttacatttctcatatataaagaattcctacaaattgatagaaagaagacaacctgatagaagaacgggcaaaatatatgaacagatatttcctcagaaaaaaacaaaaattgtcaataaacatttgaaacac

SEQ ID NO: 119531 - DNA, 5060 bp, Homo sapiens
  Payload ID: 3426
  Gene Symbol: C9orf84
  Gene Name: chromosome 9 open reading frame 84
  Uniprot ID: Q5VXU9
  ENST ID: ENST00000394779
  CDS Start-End: 246-4463
agacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagagactctgggggatgaattggagatattaagaggtaaaatgatgcagagaagaccaaggtcagcagaagtcaaatacttctatttctttaaaattttgcttaggctacgcctggctattttgaagtatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatcatgtctagaacataaaagtcattcttcacctattgcacttattgatgaaaaatctacaaatgctcatttatcacttccacaaaagagtccatctctggcaaaagaagtaccagatctatgtttttctgatgactatttctctgataaaggagcagcaaaagaagaaaaaccaaagaatgaccaagaaccagtaaacagaataatccaaaagaaagaaaataacgatcactttgaacttgactgcacaggaccatctattaaatcaccttcctcttcaataattaaaaaagcatcttttgaacatggcaaaaaacaagagaatgatttggaccttttgagcgactttattatgctgcgaaataaatataagacttgcacctcaaagactgaagtcacaaacagtgatgaaaaacatgataaagaagcatgttctttgacacttcaagaagaaagtcctattgttcatattaataaaaccctggaggaaataaatcaggaaaggggaacagatagtgtcattgaaattcaagcgtcagatagccagtgccaagcattttgcctcctcgaagcagcagcttctcctatcttaaaaaaccttgtatccttgtgtaccctccctactgctaattggaaatttgccactgttatttttgaccaaacaaggtttctcttaaaggaacaagaaaaagtagtaagtgatgctgttcgccaaggtacaattgatgaaagagaaatgactttcaagcatgccgctctcttacatcttctggtaacaattagagatgtccttttaacatgcagcttggacacagcattgggatatttgtcgaaggcaaaagatatctacaacagcattttaggcccctatttgggtgacatttggagacagctggagattgtacagtttattagggggaaaaagcctgaaaccaactacaagatacaagaattgcaatgtcagatactaagttggatgcaaagtcaacagcaaattaaggtactgattataataagaatggactcagacggtgaaaaacattttctcattaaaattcttaacaaaatagaaggtttaacactgactgtccttcattcaaatgaaagaaaagattttctggaatctgaaggtgttttaaggggtacaagttcctgtgtagttgtacataatcaatatattggagcagatttcccctggagtaatttctcatttgtggtggaatacaattatgtggaagactcttgttggactaaacactgcaaagagttgaatattccttacatggcctttaaagtgattcttccagacacagttttagaaagaagcaccttgctggatagatttggaggttttcttttggaaattcagattccatatgtgttttttgcatctgaaggacttcttaatactccagacatacttcagctgctagaatccaactataacatctcactagtagagagaggctgcagtgagtcattgaaactctttggaagttcagagtgttatgtagtggtgacaattgatgaacacactgccataattttgcaggatctagaagaattgaattatgagaaggcatcagacaatatcattatgaggctgatggcattatcattacagtacagatattgttggataattttatataccaaagaaacattaaattcagagtatctgcttacagaaaagacacttcatcacctagcactgatttatgcagctttggtttcatttgggctaaactctgaagaactggatgtaaagcttataattgccccaggagtagaagcaactgccttgataattcgacaaattgctgaccacagtttaatgacctcaaagagagatcctcatgaatggttggataaatcctggcttaaagtttcaccatctgaggaagaaatgtacttacttgattttccatgtattaacccattggtggctcagctcatgctaaataaaggaccttcactgcattggatattattagcaactctgtgtcaacttcaggaactcctacctgaagtcccagaaaaagtgttaaagcatttttgtagcatcacttccctattcaagattggttcttcttccataacaaaatcaccgcaaatttcgtcacctcaggaaaataggaatcagattagtaccttgtcttctcaaagttcagcttctgatttagactctgtcattcaagaacataatgaatattatcagtatttaggattaggagagacagtgcaggaagacaaaaccaccattttgaatgacaactcttccattatggaactaaaagaaatctcaagttttttaccacctgtgacttcatacaatcagaccagctactggaaagactccagctgtaaatctaatatagggcagaatactccttttctaattaatatagaatcaaggagaccggcttataactcctttctaaaccacagtgattcagagtcagatgtcttttctttgggtctaacacaaatgaactgtgaaactataaaatcaccaactgacactcagaagagagtgtcagttgtcccccgttttataaattctcagaaaaggagaacacatgaagcaaaaggtttcataaataaagatgtatcggaccctatcttttcactagagggcactcaatctcctcttcattggaactttaagaaaaatatatgggaacaagagaatcacccgttcaacttacaatatggtgcacagcagactgcatgtaacaaattgtactctcagaaaggtaatttattcactgatcagcaaaaatgtctatcagatgagtctgaaggcctcacatgtgaaagttcaaaagatgagactttctggagagaattaccatctgtccccagtttggatttatttcgtgcttctgattctaatgcaaatcaaaaagaattcaacagcctttatttctaccaaagagctggaaaaagtttaggacagaaaaggcaccatgaatcttcatttaactcaggagacaaggaatcattaacaggttttatgtgctcacaactaccacaattcaaaaaacgacgtctagcatatgaaaaagtccctggtagagttgatgggcagactcggctgaggtttttttgaaggaggagaagagcaatgttacatgccatattccactgtttttgatgctaatccactagcgcaattatttagatttgctcatacactaaagaaaacacaattgttcatatatgtctcagtatttctgtattaaatattcataatatgtattctgccctatggtttgcatctttgtaagttaaatattctaatttatcaattagcagaataattatcataagatccaaaatgtcttccagacacccctgcacacaggccatttaaatgagtctccatcacagtctgaccctttgagtcaggaagtgaagatcatcacagttaaccctcccacatcaagaaagttaaaacctaggacaaaattgaagttagaaaacttccaacttaaagtatcattttctgtaaacacaatttaagaacaaattactaagaggaaatatttgcaacccagataataggaaaaaaagtttacatttctcatatataaagaattcctacaaattgatagaaagaagacaacctgatagaagaacgggcaaaatatatgaacagatatttcctcagaaaaaaacaaaaattgtcaataaacatttgaaacac

SEQ ID NO: 119532 - DNA, 1279 bp, Homo sapiens
  Payload ID: 3427
  Gene Symbol: C9orf85
  Gene Name: chromosome 9 open reading frame 85
  Uniprot ID: Q96MD7
  ENST ID: ENST00000334731
  CDS Start-End: 191-664
gggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaa

SEQ ID NO: 119533 - DNA, 539 bp, Homo sapiens
  Payload ID: 3427
  Gene Symbol: C9orf85
  Gene Name: chromosome 9 open reading frame 85
  ENST ID: ENST00000377027
  CDS Start-End: 1-68
aaaatgacaagttcgataaaagtgtgcagaccaagtctttatctgcaaactctagtcatgatgtttgagtttgtctccctgtggagcaggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaat

SEQ ID NO: 119534 - DNA, 1107 bp, Homo sapiens
  Payload ID: 3427
  Gene Symbol: C9orf85
  Gene Name: chromosome 9 open reading frame 85
  Uniprot ID: Q96MD7
  ENST ID: ENST00000377031
  CDS Start-End: 191-730
gggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccatggagtctccctctgttgcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatgatctgcctgcctcaacctcccaaagtgctggaattacaggtgtgagccatcatgcctggcctaatttgtatatttctaatgactcatgatgttgactgagcatcttttcttttcttttctttttttttttccttgttttttgagatggagtcttgctctatagcccgggctggagtgcagtggcaccatttcagctcaatgcaacctctgcctcctaggttcaagtgattctcctgcctcagcctcccgagtagctgggattacaggcacacaccaccatgcccagctaatttttgtatttttagtagaaacaggttttcacaatgttggccaggatggtctccatctactgaccttgtgatccgcccccctaggcct

SEQ ID NO: 119535 - DNA, 3321 bp, Homo sapiens
  Payload ID: 3427
  Gene Symbol: C9orf85
  Gene Name: chromosome 9 open reading frame 85
  ENST ID: ENST00000486911
  CDS Start-End: 75-284
gggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgatggagtcttgctctatagcccgggctggagtgcagtggcaccatttcagctcaatgcaacctctgcctcctaggttcaagtgattctcctgcctcagcctcccgagtagctgggattacaggcacacaccaccatgcccagctaatttttgtatttttagtagaaacaggttttcacaatgttggccaggatggtctccatctactgaccttgtgatccgcccccctaggcctcccaaagtgctgggcttacaggcatgagccactgcacccagccgactgaacatcttttcatgtgtttattagccaatcctatatcttcactggtgaaatgtctattcagatgtgttgcccattttaaaaattgggttgttttcttaccattgagttatgagtcttttatatatattctagatacaagtcctttatcagatataatttggaaatattttctcgctgtctgtaatgtgttatacatcaattttgagatatccttcacattaagaaactaacggtgtggataataatcctggtattgacagaggtttggactcctgaagcctgaaagtctatctgctgccacgcctgggcacatactgcatcatttacaaaactgtagagcacctgttgtgtgtgcagttgtgatttcttatagatttttagaattggaaggcatgtaaagaacacgtaatctggtacattgcttcagtaggtaagtcagtatgaacttctaagaatttttgttttcttctgtattgggtctattgtgggtatgtccaacgtgacaggggaggtaagggaagtggcatcccctgagatagtgactgaaatggctttcatcatctttaagtcaaagtgagatgccagtaataggatatatgtatgtatgtacttgtgtctctgtatgtatgtaaataaacaaacatgctggaaggaggaggtgattcaatcagggactttgtgaaagaaaaaaagaataactggaccttcctttaatgatgaaaactgtttatacagcaaaccatcaaagccaaaatgtgaattttggtattagcccgatttttcctaagaaactgttgatgtaaccactgtagttgcagagatcgttttggtatattctagaccctctttgttttgttctgtttggggtttcttccccctcaagttgctcttgtccaccactagactggctgccttttattccatagcagacagtccttaagtctttgcatatgtccttattcaaaaattaatcttcatcagtttttttctgcagaaaacagttttttaaatatcttacatgagaatgctctgcacctgcaatctctggttgatgcagtttcctttctctcttctctgttcccattggtagaataaatctgctccttcttaaatcctgagctgaaaatgtccacacttcccagaagtgtactttagaatcacctgtaacatgtatttaaaatacagattccccagctccacgggcaaagctctcctgccatgtgacaccctgatacagttcagggagccactaaggcaggccaaaatggctcagcaggcaaaggtccaagctgccagggtagtgtgtcattacagcatgcttagcatagctaggaggacaggctcacacccagccccacagctgttgcgctacagactcaggcacagggctgtctaactggcagatgtgggccacaactgttggagacaagccagccatatttgggaaaatcttattgtaaggggcaagtgtgagtgagatttaggagtcatgggaaaatacaccaacacagtaaatcttgtgttataggagagatgtggaagaaagagataaactactggccagggtgtctcctgactgggtgacttgccaccacatgggccaggcaggttgcggcagctctgcctttgggaggtggctggaggaggggaggagagagaggcatgatgaagacagatgcaccctttcctgagcaggggttaacattcagggtgccgaaaggaattccacagcctgtttcccatctctcttgtcctcatcaagtactggtcctcgtgtatgtgttctgcttccgctttctcaggatgtttacgtttttgcaaatacgtttatggaaaagagttacctcacccacctctccaaacatctatttgttttacatttttattgcgggggagtgatctctttacatagcttcaaatggcataacattcagcagtatccaagcttagatatatctgatgagaggaaagtaattgtgaggcctttgttctagttacaactttgtcactatctgactccatgactccagcaaattgcttcaactgtctggcctgcagtttttttcttgcgttaaataacagacttagtctagatcggtggttcttatcatgtggtttctggactagcagcatcaatattacctgggaaacttgttagaaatgcaaattcttgggctctgccctagacctactgaaacatactctgtgggcggggcccagcaatctgtgtttgaaacgcgattctgattatttgacaaaagtttgcaaaccactggtctagataagtagctcttagccttggctgcacattaaaatcatctgggcaacttttataacctaccaatcctggcctcttcctccaaagattctgacttaaatggtttcagatggggaccattgttatgcggttatagccgacgcctaggtgctacctgaggtcttcaaagctaaaggtcagtgtttcccagccgtaaatgcatacctctagacctggccttctcaagccactaggtgttgctataatagagaagaaaaggcattttcagaaccgtctttggatatggatgaggaggaggaaaatgtatttcttagcttctgataagagattattttgttattttaatctgagtgcaatttgctaaatattcatttgcaacttgttaaatttattcaaagaaattaaatgcccataagtgacagaaagaataaagaattgtgatatatatttacaataaaatactctttagcaataaaaa

SEQ ID NO: 119536 - DNA, 902 bp, Homo sapiens
  Payload ID: 3427
  Gene Symbol: C9orf85
  Gene Name: chromosome 9 open reading frame 85
  Uniprot ID: Q96MD7
  ENST ID: ENST00000479413
  CDS Start-End: 226-333
ggctgcgccgcgtggagtggcttggcttaacagcagggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaa

SEQ ID NO: 119537 - DNA, 678 bp, Homo sapiens
  Payload ID: 3427
  Gene Symbol: C9orf85
  Gene Name: chromosome 9 open reading frame 85
  ENST ID: ENST00000473252
  CDS Start-End: 95-229
tgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagtctttatctgcaaactctagtcatgatgtttgagtttgtctccctgtggagcaggggtccccagcccccgacccccgcatcggtccatggcctgtcaggaactgggccacacagcaggagttgaactgcaggtgtggtaacagtattgtggttaagcacgagaaggtctttattgctaggatatgatgagtattaagaagtgaagtgtcttgatatccataagttattttacctgtacccatacacacaaaaagcaaaaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattcc

SEQ ID NO: 119538 - DNA, 894 bp, Homo sapiens
  Payload ID: 3428
  Gene Symbol: C9orf9
  Gene Name: chromosome 9 open reading frame 9
  Uniprot ID: Q96E40
  ENST ID: ENST00000350499
  CDS Start-End: 155-661
ctcgcctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgggacgacttagcttctgtattattgttgcttcctcagggggagacagtcaagaataaaaagtattctaccacctctctgcctgacttggtttcctgggatttatccctgaaagaaaacctacatctcccctaagacatcaaaggacactgggcagtaagcctcagcagacagcagagagagaggccaccctaggcaagggggcatgcctgtctcaagtcggcttctaagaggctcatgcccaag

SEQ ID NO: 119539 - DNA, 2243 bp, Homo sapiens
  Payload ID: 3428
  Gene Symbol: C9orf9
  Gene Name: chromosome 9 open reading frame 9
  Uniprot ID: Q96E40
  ENST ID: ENST00000356311
  CDS Start-End: 155-823
ctcgcctcccaagtcctggaacgggcctccccaccctccggggcaccgacactcacggagtcactccaacttctctgggtgctccgtggagcgaagagcgctctaggacaagcaaggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccatggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacct

SEQ ID NO: 119540 - DNA, 2536 bp, Homo sapiens
  Payload ID: 3428
  Gene Symbol: C9orf9
  Gene Name: chromosome 9 open reading frame 9
  Uniprot ID: Q96E40
  ENST ID: ENST00000372136
  CDS Start-End: 448-1116
gacacacgaatcgtacatcccgagttgggctgcttcgtgggcgcgcgactcggccccagctgcgggtcccggccgcgcacccgacgtcgcagtggaggctcccgagccgccgccagcgtcgcgacgggcaggggtgtccggtcacctgcatcaactcgaagatgtggttctcctccccgtactggggcatctcgggggggatacggtgcggggcgatagtggcgtccatgtagccgtctcggctcgccgctccctagtaaccgcgtcgctagggccgccgcgccgactgcgtcatcagcacgcgccgcggccccgccctgcaggctccgcgccgggcccagatacccgatcctcggtcgcgcgggtcgcccccgccccgacctccccggctgacgcgctctgcggctcggattcctcttctcctgtaaatgaccacagaggaagacaatgaatgaggtgaaagaatcccttcgcagcatcgagcagaagtacaagctcttccagcagcagcagctcaccttcaccgccgctctggagcactgcagggagaacgcccacgacaagatccggcccatctccagcattggacaggtgcagagctacatggaacactactgcaacagctccacagaccggcgggttctgctcatgttcctggacatctgttcagagctgaataagctctgccagcactttgaggccgtgcactctggcaccccagtcaccaacaacctcctggagaaatgcaaaaccctcgttagccaaagcaacgacttaagcagcctcagagcaaaataccctcatgatgtggtgaaccacctcagctgtgacgaggcccggaaccactacggcggcgtggtcagcctcatccccctcatcctagacttaatgaaagaatggatcgcccactccgagaagttgccgcgcaaggtgctgcagcacgtgagtgagccccaggcgcaccaggagagcaccaggggagccgctcgtcctgcccaggccatagggacccagcccagggccactaaacacaagtgtagacagctcacaaaagccagcctcaaacccaggggatgttcaaaaccaccctggaggcctcctggtgggaaattgtaactcagagccaggagctccgtcggcggagagctttgctgtttaatttggattttactggttggtccttttttcactggtacccatggaccctgccacttactaaccccaagggaatcagccaatatattactgagacttcctctctctcttcttgctttaacttcttttttttttgagacggagtctcgctctgtcgcccaggctggagtgcggtggcgcaacctcggctcactgcaacctccgcctcccaggttcacgccattctcctgcctcagcctcccaagtagctgggactacaggcgcccaccacctcgcctggctaattttttgtatttttagtagagacagcgtttcaccatgttagccaggatggtctcaatctcctgacctcatgatctaccctcgtgatcggcctcccaaagtgctgggattacaggcgtgagccacagcgcccggccctcttgctttaacttctaacatttccacttctaagcatcaggctccgtgctgatgaagaggaaacccacttacagaagttgcccaaacaggatggtgtggtagagggtcccaggagggcactgaactgtcacctaggtcctctttgagccacatccggctccagtgccacgcctgtccctgctgcgggctgcagttttgcagagggtgatcaagctggagaccatctgctccttgccccaccaccagccccaactgtaggcaaggcacacgctgtttgcgagccagggatgctcccctccaggatggagtgggggtcggcatgtggaactcagcgtgtttatttttttattttttgagatggagtttcactctgtctcccaggctggagtgcagtggcacgatcttggctcactgcaacctccacctccaggttcaagcgattctcctgcctcagcctcctgagtagctggaattacaggcgcccaccaccccacctggctaatttatatatatatatattttttagtagagacggggcttcaccacgttggccaggctggtcttgaactcctgacctcaactggtccacccgcctcggcctcccaaagtgctgggattacaggtgtgagccacggcacctggccagaactcagtagtgtgtttagttctctggaccacagccaaaggggaataaactcacctttccttcgcctttacttgggagagggagaccatgacagaagccagaattctgattttgtggctcctgagcaagggcgatgacctggttttcacagcgtagtcgaaccccaaacattgtaaaatgtgtccctggcttctgagcttgcccaaagtaatgtctgactgttggtttttcccttcacaggggacgacttagcttctgtattattgttgcttcctcagggggagacagtcaagaataaaaagtattctaccacct

SEQ ID NO: 119541 - DNA, 2314 bp, Homo sapiens
  Payload ID: 3429
  Gene Symbol: C9orf91
  Gene Name: chromosome 9 open reading frame 91
  Uniprot ID: Q5VZI3
  ENST ID: ENST00000288502
  CDS Start-End: 438-1466
ggcgggaacccgtgccccaagatgccgtgcacgtggtcggctccgcgcggaggctccttccggcgtcccgggggggcgctcggctgatgaaacgcggcctccagctccgctccgccgcgggcccgggaggcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggctt

SEQ ID NO: 119542 - DNA, 4578 bp, Homo sapiens
  Payload ID: 3429
  Gene Symbol: C9orf91
  Gene Name: chromosome 9 open reading frame 91
  Uniprot ID: Q5VZI3
  ENST ID: ENST00000374049
  CDS Start-End: 438-1469
ggcgggaacccgtgccccaagatgccgtgcacgtggtcggctccgcgcggaggctccttccggcgtcccgggggggcgctcggctgatgaaacgcggcctccagctccgctccgccgcgggcccgggaggcgcgttccctcttggccccaaagcgagtccggcgggcggctcctcggggttgggcgaccgagcggggccggccgggcggggggcgggcccgtgaaggcggcgcagcgcggcgcgggaggcgtgctgggcgcggggctgcggtgcccagaggctgcggcattaggggctcggcgcccccgaccttccgcgtcccggggtggcggcggcggcggcggcggcggcgcgggcggcatatgatgctgagctggctgctccagaatgaaccacagctctgagaaggggaagtagaaacagctggcgccctgccatggcctgtgaaccacaggtggacccgggggccactggcccattgcccccctcctcccctggctggagtgccctgcctggagggagccctcctggctgggggcaagagctccacaatggccaggtcctcactgttctccggattgacaatacctgtgcacccatctccttcgacctgggagccgcagaagagcaactgcaaacttggggcatccagcaggtcccggctgaccagtacaggagcttggctgagagtgccctcttggagccccaagtgagaagatatatcatctacaactcgaggcctatgcggctggcctttgctgtggttttctatgtggtggtgtgggccaatatctactctaccagtcagatgtttgccttggggaaccactgggctggcatgctgctcgtgaccctggccgcggtgagcctgaccttgactcttgtgctggtctttgaaagacaccagaagaaggccaacaccaacacggacctgaggctggcagctgccaatggagccctcctgagacaccgggtgctgctgggggtgacagacacagtggaaggatgccagagtgtgattcagctttggtttgtctacttcgacctggagaactgtgtgcagtttttgtctgatcatgttcaagaaatgaagactagccaagagtccttgctgagaagcagattgagccagttgtgtgttgtcatggagactggggtgagccctgcaacagcggaggggcctgagaacttggaggatgctcctctcctgcccggcaattcttgtcctaacgagaggccactcatgcagactgagcttcatcagcttgttcctgaggctgagccggaggaaatggcccgccagctgctggcagtgtttggcggctactacatccggcttctagtgacctcccagctccctcaggcaatggggacacgacacacgaactctccgagaattccatgcccctgccagctcatagaagcctacatcctaggcacagggtgctgcccgttcctggcgaggtgacctagggatgaaggtactcatcttccttcaagactgagcagtcaggaaggcttcaggagcccaagatggccaatggggagccccaggtgaggagagaagcatctgggggcactccaaaaggggcctgtgatgtcagccactggggtgttgtgctcacttcagggcccagcacaaaaatccttgtttgacatctcatgctgaccccctggcctttgcagaagctgatggttacagagctagtcccaccaaagctactctctctgctgcttagaactgtggacacgtatggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaa

SEQ ID NO: 119543 - DNA, 359 bp, Homo sapiens
  Payload ID: 3430
  Gene Symbol: C9orf92
  Gene Name: chromosome 9 open reading frame 92
  Uniprot ID: A6NGG3
  ENST ID: ENST00000380683
  CDS Start-End: 14-340
gaaaatattttccatggaattgaacaccaacattaaaagtaaaaaggggttgggaagaagaaacctaaaaccaatgaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctg

SEQ ID NO: 119544 - DNA, 379 bp, Homo sapiens
  Payload ID: 3430
  Gene Symbol: C9orf92
  Gene Name: chromosome 9 open reading frame 92
  Uniprot ID: A6NGG3
  ENST ID: ENST00000380685
  CDS Start-End: 115-348
gctttgtgggagagaggtctgtgtctgggcaaacaacctgcttgtagaggctggaagaggaaaaggccaaagacacctgaaaagaatggggcttggcccccagctagacgcgagatggctcgttttcagagaacaaaggagagggaagaagataggtgttccttgaacatctactatgtgagaaacaccacccagggcactgcacctgcctgtgttggaaagaggatgcaaccatccccaacagggaagggtggaaaatgctgcactgtgcatgggctcacaaggaagatacataatgtacagccgaatctacagtctcctattttgtcagctgcttgtgttgattaaaacttcaataaagatcctgtgataaaacaga

SEQ ID NO: 119545 - DNA, 219 bp, Homo sapiens
  Payload ID: 3430
  Gene Symbol: C9orf92
  Gene Name: chromosome 9 open reading frame 92
  ENST ID: ENST00000433347
  CDS Start-End: 1-219
gaatggggcttggcccccagctagacgcgagatggctcgttttcagagaacaaaggagagggaagaagataggtgttccttgaacatctactatgtgagaaacaccacccagggcactgcacctgcctgctcacaaggaagatacataatgtacagccgaatctacagtctcctattttgtcagctgcttgtgttgattaaaacttcaataaagatcct

SEQ ID NO: 119546 - DNA, 3795 bp, Homo sapiens
  Payload ID: 3431
  Gene Symbol: CHAMP1
  Gene Name: chromosome alignment maintaining phosphoprotein 1
  Uniprot ID: Q96JM3
  ENST ID: ENST00000361283
  CDS Start-End: 310-2748
atcccggctcctgcatccagtcgccattcgggaggccgctgcgctgcagggcctcgcggagccgcccgcgaccgcgagccgggccctccgcgcggtccatcgcccactggacgccgcccgcggccggaccggttcaacttctcatctttgttcttcttcatatactataggctgtttgctgtggtttagtcaaaaagccatgtagaatgcctgccttttgaagaccacttttaaggtgtctagtaagacagcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctccagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtcagcaaca

SEQ ID NO: 119547 - DNA, 596 bp, Homo sapiens
  Payload ID: 3431
  Gene Symbol: CHAMP1
  Gene Name: chromosome alignment maintaining phosphoprotein 1
  ENST ID: ENST00000463003
  CDS Start-End: 160-596
ttgttcttcttcatatactataggctgtttgctgtggtttagtcaaaaagccatgtagaatgcctgccttttgaagaccacttttaaggtgtctagtaagacagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgcc

SEQ ID NO: 119548 - DNA, 3090 bp, Homo sapiens
  Payload ID: 3432
  Gene Symbol: CHTF18
  Gene Name: chromosome transmission fidelity factor 18
  Uniprot ID: Q8WVB6
  ENST ID: ENST00000262315
  CDS Start-End: 64-2991
gcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 119549 - DNA, 2988 bp, Homo sapiens
  Payload ID: 3432
  Gene Symbol: CHTF18
  Gene Name: chromosome transmission fidelity factor 18
  ENST ID: ENST00000317063
  CDS Start-End: 61-2988
gtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggttctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctag

SEQ ID NO: 119550 - DNA, 1801 bp, Homo sapiens
  Payload ID: 3432
  Gene Symbol: CHTF18
  Gene Name: chromosome transmission fidelity factor 18
  ENST ID: ENST00000440239
  CDS Start-End: 61-1431
gtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgca

SEQ ID NO: 119551 - DNA, 3172 bp, Homo sapiens
  Payload ID: 3432
  Gene Symbol: CHTF18
  Gene Name: chromosome transmission fidelity factor 18
  Uniprot ID: Q8WVB6
  ENST ID: ENST00000455171
  CDS Start-End: 62-3073
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 119552 - DNA, 790 bp, Homo sapiens
  Payload ID: 3432
  Gene Symbol: CHTF18
  Gene Name: chromosome transmission fidelity factor 18
  ENST ID: ENST00000426047
  CDS Start-End: 1-790
caccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagctgacccatctggatggcttcattcctttggcacccctgtccagtctcccacccctcactggccagcttactgggggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaag

SEQ ID NO: 119553 - DNA, 711 bp, Homo sapiens
  Payload ID: 3432
  Gene Symbol: CHTF18
  Gene Name: chromosome transmission fidelity factor 18
  ENST ID: ENST00000569270
  CDS Start-End: 1-245
gaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgct

SEQ ID NO: 119554 - DNA, 569 bp, Homo sapiens
  Payload ID: 3432
  Gene Symbol: CHTF18
  Gene Name: chromosome transmission fidelity factor 18
  ENST ID: ENST00000563545
  CDS Start-End: 62-373
agtgcgcgacggcggcggcggcgcgggaggttcggagcgggagctcgggctcgcggacggtatggaggactacgagcaggagctgtgcggcgtcgaggatgatttccacaaccagttcgcggccgagctggaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggagga

SEQ ID NO: 119555 - DNA, 3555 bp, Homo sapiens
  Payload ID: 3432
  Gene Symbol: CHTF18
  Gene Name: chromosome transmission fidelity factor 18
  ENST ID: ENST00000631357
  CDS Start-End: 1-3555
atgcacgtgaatgcctctgcccgacggtgggggcggggaggggctgcagcactaccaggcccggcagccagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccctgcaccgctgcgcgcgcagccccgcccccccccccggcccgcccccggcccgcccccgccgcggaagggcggctgcggcggccaatggcgagctccccaggacaggacgcgggggctgcggagcaggaactcgccccgcccacccctcgcgcagccccgcctccgccacgccaaccaatggcgcgcgccgccgggcacgccggctgctgattggcggcgcccggcacgctcggggcgggcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggttctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctgggcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctag

SEQ ID NO: 119556 - DNA, 2561 bp, Homo sapiens
  Payload ID: 3433
  Gene Symbol: CHTF8
  Gene Name: chromosome transmission fidelity factor 8
  Uniprot ID: P0CG12
  ENST ID: ENST00000306585
  CDS Start-End: 143-1717
tcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggc

SEQ ID NO: 119557 - DNA, 1073 bp, Homo sapiens
  Payload ID: 3433
  Gene Symbol: CHTF8
  Gene Name: chromosome transmission fidelity factor 8
  Uniprot ID: P0CG13
  ENST ID: ENST00000398235
  CDS Start-End: 94-459
gggtggccgagcgcgggcggaggacggagaagggggcggcgagggccggaatctcgagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggc

SEQ ID NO: 119558 - DNA, 2903 bp, Homo sapiens
  Payload ID: 3433
  Gene Symbol: CHTF8
  Gene Name: chromosome transmission fidelity factor 8
  Uniprot ID: P0CG13
  ENST ID: ENST00000448552
  CDS Start-End: 123-488
agtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggc

SEQ ID NO: 119559 - DNA, 856 bp, Homo sapiens
  Payload ID: 3433
  Gene Symbol: CHTF8
  Gene Name: chromosome transmission fidelity factor 8
  ENST ID: ENST00000519520
  CDS Start-End: 137-175
ggaagtgcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaaccc

SEQ ID NO: 119560 - DNA, 475 bp, Homo sapiens
  Payload ID: 3433
  Gene Symbol: CHTF8
  Gene Name: chromosome transmission fidelity factor 8
  ENST ID: ENST00000520529
  CDS Start-End: 99-137
ggaaagggtggccgagcgcgggcggaggacggagaagggggcggcgagggccggaatctcgagcttgttttcacttgctttttaaagacagaaagctcatggtgcaaattgttatttccagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgg

SEQ ID NO: 119561 - DNA, 831 bp, Homo sapiens
  Payload ID: 3433
  Gene Symbol: CHTF8
  Gene Name: chromosome transmission fidelity factor 8
  ENST ID: ENST00000522497
  CDS Start-End: 1-433
ggcagtgctcgcggcggcggcgacggcggcgggaggttcggttgtcgcccgttggccgcgcggcgccgcgctcggcggccgccattgcagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggg

SEQ ID NO: 119562 - DNA, 567 bp, Homo sapiens
  Payload ID: 3433
  Gene Symbol: CHTF8
  Gene Name: chromosome transmission fidelity factor 8
  ENST ID: ENST00000518041
  CDS Start-End: 35-211
ttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattaggg

SEQ ID NO: 119563 - DNA, 766 bp, Homo sapiens
  Payload ID: 3433
  Gene Symbol: CHTF8
  Gene Name: chromosome transmission fidelity factor 8
  ENST ID: ENST00000523421
  CDS Start-End: 120-347
gctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagcttcatcaggctcattggcttcaaatccagcacctttcccggctggtgctcgtgacccaagtatggcttcttttccaagagggatgaatcccactggcacagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtggggg

SEQ ID NO: 119564 - DNA, 734 bp, Homo sapiens
  Payload ID: 3433
  Gene Symbol: CHTF8
  Gene Name: chromosome transmission fidelity factor 8
  ENST ID: ENST00000567763
  CDS Start-End: 1-314
gcagtgctcgcggcggcggcgacggcggcgggaggttcggttgtcgcccgttggccgcgcggcgccgcgctcggcggccgccattgcagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctc

SEQ ID NO: 119565 - DNA, 863 bp, Homo sapiens
  Payload ID: 3433
  Gene Symbol: CHTF8
  Gene Name: chromosome transmission fidelity factor 8
  ENST ID: ENST00000522091
  CDS Start-End: 131-430
gcgcaggcagtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgaggtgagggggcttttctttccctgcctaatgcctcaggaaagcaagctacaccaaggtggtgctcccaggacccagagtgaggactgcctcaggtttgttattcaaggcctagctaatctgcgatgctctctgcttgttctccccctacctctgcagtagcagggaaatttaattttggggaatctggaaagctcacatttctgaaagtggaaattctcctatgtggggctagaaagtaaaaagggcacatgggtgggtggtccagtgtggctgctcaacaatggcagagccagaccagggattggaggtgccagcatagcctgccaagagcagctttaggaggcgcctgagtgttatggccttgccccggaacctcaggaatctcgttcttgttctgccaaagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgcccc

SEQ ID NO: 119566 - DNA, 723 bp, Homo sapiens
  Payload ID: 3433
  Gene Symbol: CHTF8
  Gene Name: chromosome transmission fidelity factor 8
  ENST ID: ENST00000519534
  CDS Start-End: 1-198
catatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttca

SEQ ID NO: 119567 - DNA, 1855 bp, Homo sapiens
  Payload ID: 3434
  Gene Symbol: CXorf21
  Gene Name: chromosome X open reading frame 21
  Uniprot ID: Q9HAI6
  ENST ID: ENST00000378962
  CDS Start-End: 324-1229
acaaatcggacttgaacaaaaacaactctttttccatgggaccaattataaaaagaatggctttgcactgagcagctcagtctactggtctcatcagtgaaaggcttgtgaaaatttctggaaagagcattggctggcttgttcatctctctgtttggtcagttgctgtgtttctgccggatcagatgagcagattggttagtgaaggtcagtgtgagaagaagattgtttctgagcttgagaagcttctggaggattgaagagtatttgaagtctgtgtcaaacatccatatcataagtggaattttggagatattcaaagaatgctgtcagaagggtatctcagtggacttgagtactggaatgacatccactggagttgtgcctcttataatgagcaggtggctggggaaaaggaagaggagacaaattctgttgctaccctttcctattcctctgtggatgaaacacaagtcagaagtctctacgtgagctgcaaatcatctggcaagtttatctcttcagtgcattcaagagagagccaacatagcagaagtcagagagtcacagtgctgcagacaaaccccaatcctgtgtttgaaagcccaaacttggctgcagttgaaatatgtagagatgccagcagagagacctacttggttccatcttcttgcaaaagtatttgcaagaattataatgacttacagattgcagggggccaggtgatggccattaattcagtgacaacagattttccctctgagagcagttttgaatatggccctttgctgaagtcatctgagattcctttacccatggaggattccatttctactcagcccagtgactttccccaaaaacctatccagcggtactcatcctattggagaataacaagcatcaaagagaaaagcagcttgcaaatgcagaatcctatttctaatgcagttctgaatgagtacctggagcagaaggttgtggagttatataaacagtacattatggacaccgtgtttcatgacagttctcctacccagattctggcgtctgaactcatcatgacaagtgtagaccaaatcagtcttcaagtgtctagagagaagaatctggagacctcaaaagccagagatatagtctttagccgcctattgcaattgatgtcaactgaaattactgaaattagcactcctagtctccatatttctcagtatagcaatgtaaatccatagagaggatgcttccattactgtctcgcatttacttaaacatgaagcaacactttatccatttattctgagaatgtgcaggaggggttagtgaaggggaattaagggctagagaagtaaagatcagctggaagtcatgtgtgaatcatggagaaatctcataatattacacttgatgaaggaatatggtaagaggagccataaggaatgatttcaaagagaggtgtgtacagcaaggaagcaaaaataaaaatgatcaaaaaagaaacggttaattcatttgaagaaacataggaattaaaaaagaagacagtcaaatgagatgaaacaaaaaggccaaaaggtggccgggtgtagtggctcacgcctgtaatcccagcatttcggaggctgatgtgggtggattacctgacgtcaggaattcgagaccggcctggccaatatggtgaaaccccatctctactaaaaatacaaaaaattagctggacatggtggtgggtacctgtaatcccagctactagggaggctgaggcaggagaatctcttgaacctgagaggcagaggttgcagtgagccgaggtcgctccattgcactccagcctgggcaacaagagtgagactcccgtctc

SEQ ID NO: 119568 - DNA, 2272 bp, Homo sapiens
  Payload ID: 3435
  Gene Symbol: CXorf23
  Gene Name: chromosome X open reading frame 23
  ENST ID: ENST00000340625
  CDS Start-End: 1-703
aagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagggtctcgctctgtcacccagactggagtgtggtgtcacaatcacagcttactgcagcctctacctccaagactcaagctatctcccacctcagcctcctgagtagctgggactacaggcatgagccaccatgcccagctaagaataaaaattaaaaatatatatattgatatataaaatgagctaggaagccagcttgagagaaacctactttctcaccatcattgactctttctgttttaacatctataaggcctagaatccaggacagctccaagtaccagacagtttttcatctgtttttttgttttgttttgtttgagacagggtctcactctgtcacccaggctggagcgcagtggcactcttttgtacttttcaagcatagagaacagtgactcgctgcaacgtccgcctcccaggttcaagcaattctcctgccttagcctcctgagtagctgggattacaggcgcctgccaccacgcctggctaatttttgtatttttagtagagacggggtttcaccatgttggccaggctggtctcgaactcctgacctcaagcgatcagcttgaggagttctgcctcagtctcccaaagtgctgggattacaggcgtgagctactgcacccaaccacccactcatctgtttactaataaagtagacttggaaggtgtagttttagcatttaattccttttttttccttcacagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatttaaaaatgtttagtgacttttaaactcctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggaaactcaggtaaaggcttttaattgatgtattttaatcttatacaaagtgaattatctgaatgccaaaaatatattgaatatatacaaagggtgcataattgcaaaatacactaactcttttccccattcatatatttttttgttgtggtaaaatatgtataatataaaatttgccattttaaccatttttaagtagcatcaagtacatacagttcagcgacactaatttcattcacagtgctatgcaatcatcaccattatatgttcttttgcaatttatgtttttaattgacaagtaaaaattatatatatttatggtgttcaacatgatgttttgatgtatgtatacattgtggaatggctaaatcaagctatttaaaatacccattacctcacatacttatttttttgtattgagaacacttaaaatctactctgttagcaattttcaggtgtacaatatattgtaattaactgtagtcaccatgatgtataatacatcttttgaacgt

SEQ ID NO: 119569 - DNA, 3217 bp, Homo sapiens
  Payload ID: 3435
  Gene Symbol: CXorf23
  Gene Name: chromosome X open reading frame 23
  Uniprot ID: A2AJT9
  ENST ID: ENST00000379682
  CDS Start-End: 35-2170
tgtaaaaagtggatagtggctcacgtgtcaaaggatggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaaggtaaagaatgttcatactgatggattccaaaaacccacacattttataaaatcaaattttagaaaatgtattgaaaaaccttacatgaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgctt

SEQ ID NO: 119570 - DNA, 6528 bp, Homo sapiens
  Payload ID: 3435
  Gene Symbol: CXorf23
  Gene Name: chromosome X open reading frame 23
  Uniprot ID: A2AJT9
  ENST ID: ENST00000379687
  CDS Start-End: 35-2083
tgtaaaaagtggatagtggctcacgtgtcaaaggatggcacggtcacgatctagatcccccaggtggaaacacaggtctttatcaccagtacctagaaatgctgaacactacaagcaaagacattcacacgggcattatggctgtgaatataggaaggatccaaaaagacccgtcgcgtggagaatggacagtgagaaacatggacagagtaaaccaaggattccctctcgtggaaatatatattaccagtcttatgaacatagatcaccttcccctaacataagaaactctttagaaaatgtttatatgtataagcctcacagaggatattcgcctggaagaggggacagtaacaggagagctcagtatatgcccaaatactcagagggtataccctacaaagagcatgaaaggaattcttatccccagaaagtgcaaggagggcatagtcctgatgaccacagagttagaggaagtggaaaaggagggaaaccacctcagaggtcaatagcagattcttttagatttgaaggaaagtggcatgaagatgagttgaggcaccagaggatacaagaagaaaaatactcccagtcaactagaagaggctctgaagactttgagacaaggagctcatttcagaagaggtatcctgaggatcgtgatttcagaaaatatggacacacatcaaaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataagttacttgccagtttgtgagagcattattttaattttgtttgagacttatagccttggatagcacctctgtttaaacagtgtttaaagcactgttctgtgcttacaaagacagagctttcaaaattaaaatgtgaaggttgataagaacttggtttttcatgactggatgtgaaaaatcttagtacattcagttttcttgtccatatctttaaaagagagggcagccttttccttaagtgagttcatgataaggggggcaagtgcacttgattcattgctaagcaggtaataaatttgggtagatggcctgtcttgtactgtgtacaatctctataggtcaggttttccaaacatatttagcattccacttatggtaagaaagaaatgcatgcacacaggtagtatggcaactttatattgtgttaggtacttataaaatctgtcttaaattttaaaataattgatttcatttactcccatattctaggggacagtaatgagctttgaatatttaatcatttgattgacaactatgtattgcacagatactgtactaaaattacagcaatgaacaagaagacaagacacatggaccctgcctttatggtacgaagagtctaataggaaaaatggacattaaacagaaatataacttggtaaatcgcctttatagctcgctttttatttattgtaacacataaaggtaagatggctgatttactattattcattccacaactgattccctatttggatattcttttggcactgtctcaatatgcaaagcgtgttatctgcaaaatacctgtgcagaaaacattgtgtgtataagatctaaagcctaaaaggaaaaaccaactttataatttagagtataaaataaggacagggaccgtgtctgtcttgtccaccatagtatccccagcacccagcttcctatttgacgtgtggtaagagttcattaaatattagttgaataatgaatgaataaatagggaataatagaatatgtttattaggaactacatgtgtaattttcatatggagattgaacaaaaggttatccatagcattttttattgactggaaagaatttgacttcttgaatgcataagacttgagaagagaagttttttttttttttcttttttttgataagtcccctaccattgcctcctcaccttcctccactacgtgctaggcccttcgctggtactgggaagacaaagataataagacacagtccctgctgtgaggaagctcatgcactgctgaagaagagattcacaaaaacaaagaatcacaatgtagagtaagtactttagtggacatatatacaaaaggttgagaggaaagttgacatttctgattcagcatcccctcgtcatgtttctttcctattggtttcaccaacctcagaaggcactattctgttggtggttttactggttttaaaaattgatgcattgggggaaactgggtaaattgtacgcgggatctctctgtattatttcttttatagctgcatgtgaatctagagttacttcaacataaatttcaatttgaagaattgcccatagtcttatcacagagaacactattataaatattttagatgatacattttcatttttttctattggaaaaaaactcgctacatttatgtgtaacaatttatgtagatgtatactatgtaccacattttacctaataaatcctacatttttgaatagttttttttttaaaaaaaagacggggatacttccaggcagaagcaagaaaagtaaagctggatgagaaactcttattgtctttattacccagcaaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcagaaggggtaagattcaccaggactaggcatttcccaggtctcagagcagcctgggaaagccaaatcctgcagaagtcagagacacctttgactgtgtctagtgagttctggttctggacatttaatgggaacctagaagagaggggataccaggttccccaacaaagttccgtcaaataggatgattatgagctctgagtccattaaaatacagaatgaacatttaagaactgaggaatcatagatgtagaatagtatgtaaatgttataaatcttgacaaagaaaaattaatgtacattgacaaattcagacatggaggaggtaaagtgggataaagacttaagaactaaccgtctcatcattcatggccaggtgtcatgtcacgtcatgtcttaaaattataatatggggaaaaacgctagtgaccaaccttaagtttttccacaatcttttttttccttgaccttaatacagtggttctcaaagtgtggtcccagaccagcaacatcagcatcacctgagaacttgttaaaaatgcagattcttggccccaccccagacctcctgaatcagaaaccctgggggtggggccaagcaatctgtgatttaacaagtcctccaggggattctggcacatacttgagtttgagaataactggcttatttatcccttttaggaaccaatgaagaaacatttatctgaagttcagcagccccttcaatttaatgcctaattttttttctattgcattcaaataaagttaaatctaaaacttgtttgctggccgggcacagtgagtcacgcctgtaatcccagcactttgggaggccgaggcgagtggatcacttgaggtcaggagtttgagaccagcctggccaatatggtgaaaccccatctctaataaaaatacataaattagccgggcgcagtagcatgcacctgtaatcccagctacctgggaggctgaggcaggagaattgcttaaacccgggaggcgaaggttgcagtgaaccgaggccacgccattgcactccagcctgggcgacagagcgagactccatgtcaaaaaagaaaataaataaataaaacttgttagaataaaaagtttagggattccccccgtcaatcctgtctgtacatatgagtgaattgagaggtctggaaacatacccacccactgttaacactgttgatttttttaaatggtgggattatgagtgactgtactcttctgtatctatcaaatataatgaatgttgtatcatttttataaaataaagtctttcttttttaaaa

SEQ ID NO: 119571 - DNA, 2327 bp, Homo sapiens
  Payload ID: 3435
  Gene Symbol: CXorf23
  Gene Name: chromosome X open reading frame 23
  ENST ID: ENST00000472158
  CDS Start-End: 284-1006
ttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggtcccctagctctcaaagctagacaagccaagctggaaacgtgtcctactaattctcccagttctctttccaactttaatggtttcaagtcttctcatttccatcactcattcattactacatttgtttcatccattttaatggctgcatattattccactctgtggatatatgaattatttcagtggtcttcaacctttttgctccatactgtaaagttttgaaaagttatctaccttcttgcacattggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaa

SEQ ID NO: 119572 - DNA, 2513 bp, Homo sapiens
  Payload ID: 3436
  Gene Symbol: CXorf36
  Gene Name: chromosome X open reading frame 36
  Uniprot ID: Q9H7Y0
  ENST ID: ENST00000377934
  CDS Start-End: 76-624
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaccttcacatgcagctcccatgccaccctccagaattcaccaacacacaggcccaccagcaacaggctacctttgcacaatattctctgatgacaactccaaagccccggctctttccaccacactgtggtcccctagatggggctgttgctgagcccaccccaatccagatgtgatccccctgtgatctacttctggcaagattctcagtctggacaggtcttccctatgagatagaacctgataaggagctagggcaattctgacaacattaccaaaggcccacataacttctaaattttggtctggtctgaaggaaaacctgttcttgccctagtgatggatgaactctcttatctctggcttctagagggaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaatctagatttcggtcttcattgctgtccatttttgtaatgaacgagtgtttttcctttagctagtgtatcaggcagggttctaccagagaaacagaaccagtaggagatacatatacatgtccagatttatttcaaagaattgatttacatgattgtggggattggcaagtccaaaatccatatggtaggcctgcaatctgtaaacctttgggcaggagctgatgctgtagtttgcagatagaattccttgttccttaaaaaaatctgtttttgttcttaagggctttgaatgattggatcaggcccacccagattacctagataatctcttttacttaaagtaaactgattgtaggtgctaatcacatctatgaaatgccttcacagcaacacctagattagcattcaattgaataactggggaatacagcctagccaagttgacacataaaattaaccatcacagcaacatgcctgctaaattttatcgaccgtcttcagactgttaaggattgtggtagagaactgtgacagccactctcagcatcaccctgaaccaaaggcccctatcaagtaacaatatagccaagcaaaattccagtcaatagagacattgactggttggctggcttcccaagggatagcaccagacaagaaatgcaaggatgaggaaaccaggcacgggagagagaggggcaacagaggtccagggtttggttatctttttatttttcactgggaggtggtaagttagccctgttgcccatgtatgcagatgggagaagtgatttagaaactccaaagcaattggtaatccccaaaatgggtgtatctggtttgaaatgaaaccttattttattggaaatggttggtttcccaattctgtttgccattggccaatataattgtgggtttgcacatggccagcacatgccaaacagaagtagacaaaggtctcactctgtaagtgggaccttggggaggagctgcctccatcataaagggaggggttagtaaaaatggtctcttaagcctgttcctgctacagttatagaggttgctcagaaccttctcagcaaatatagcagttatctattgttgtgtattaaaccatttcaacacatagtggcttaaaa

SEQ ID NO: 119573 - DNA, 4655 bp, Homo sapiens
  Payload ID: 3436
  Gene Symbol: CXorf36
  Gene Name: chromosome X open reading frame 36
  Uniprot ID: Q9H7Y0
  ENST ID: ENST00000398000
  CDS Start-End: 76-1377
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcagggcctggccagcccgctcctgcgctgcccttcgcagcgactcctggatcgcgtggtcaggcgctatgcagaggtggccgacgccggcagcatcttcatggaccacttcaccgaccgtgacaagctgcgcctgctctacacgctggctgtcaactcgcaccccatcctcctacagatcttccctggggctgagggatggccgctgcccaagtacctgggctcctgtggcagattcctcgtcagcaccagcaccagaccgctgcaggaattctatgatgcacccccagatcaggcagccgaccttgcctaccagctcctgggtgtcctggagtctttgaggagcaacgatttgaactatttcttctacttcacccacattgatgcaggcatgttcggcgtctttaacaacgggcatctgttcatccgggatgccagtgcagtgggcgtcatcgacaagcaggaaggcagccaagaagccaacagggcaggagagaataaagacatttttagctgcctggtttccggctgccaggcccagctgccctcctgcgaaagcatctctgagaagcagagcctggtgctggtgtgtcagaagttgctgcctcgacttctccaggggaggttcccctccccagtgcaagacgacatagactccatccttgttcagtgtggggacagcatccgcccagacccagaagtccttggggccgccagccagctgaaagacatcttgaggcccctgagaacgtgtgactccagatttgcctatcgttacccagattgcaaatataacgataagttctgaagggctggtgtctagctggccttggggacaacacgcttggctctccattctcccagtcgggttgctgcaaggtagaaagaagcagctcttttttaaagatgagaagaaaggcacactcatttcttagggactgagaggggagttgtgagataccacgtggctgtctctgctggctgggacgtcctggcaaagcccgcggtgggcatcagaagacctgggtgtggacgctcactcaatgtctttgagcctcagtttcctctgttctccaccagactctcctgagggtgaaagaagacacagatggagccaccactgagcatatatcccaagcatgggtcttgggacacatgctcaccacctccatcccaggtggttacaaagtgtgttctggaaaagcacagaggcggggagcatgagaaagagctgctcaggtcaggaggctggagtggagggaaggcaggggaaggacaggctccctgccactaccactttagactcggacaagaggggcccccttcctgctccctatggccctgcgtcactccccacaccatcgcgggatgaggagactgcaggccaaggggacatgcctgccaccacctagagcctggtacctgaggctccatacacctgcgcatggggcttctcgtggtgtgggaagaagccaggggtaagaagataaaggggggccggcgggggaccaatgtgttagcccaagtcttccaagaatatgtgtcaagatagagtgaatggaacaaagatttgttaggggaaatgattgtgtgtaaggaaagaaggagggagccggagaagattgggaggaccagtaagtcgagctgcaagctgagccccggtgaaggagagaatgtctggcaggagcttgctaagctcaaaatcaaagaaaggttcagcaaggctgtcagggtgtcctcaagacaaaggcagccatcagaagagccccgtgtctcccacaaatagaccccgttagcatccctgctgcactcagtggttggcggaaacagcaaagatagatttcagagcacagcagcaggggtccctggtcagccccgctccctagagcaggagatcttgagtgggagaacattcttgttgtagccacagctgaggccctggaccagctctctccacaccgcatgctccgagttgggactctaaggagtctaggaattttcattcaaacttggccttacaggtcactcatcagaaaaatacttttttcaaggtcaaccaatagaacatactttattcaacagtttgttagtttgctttttaaatatttagccacatggtatgtaggcttccatgtacactcttgccctggcccctgaaacataagcagggggctcttctgtacatttgcccagcttccctgccagcctttaaccccaggaacctctcagtctacctcctcttttctgcctctgaatccctacctttaaagtcagaacaggccaggcccggtggctcacgcctgtaatcccagcactttgggaggctgaggtgggtggatcacttgacatcagtagttcaagaccagcctggccaacatggtgaaaccccatccttactaaaaatacaaaaattagccaggtgtggtggcgggcacctgtaatcccagctactcaggaggctgaggcaggagaatcacttgaacccaggaggcagagtttgcagtcagccaagatcacgccactgtactccagcctggatgacacagcgagactccgtctcaaaataaataaataaaaataaagtcagaacacctggcttaataggcctcactgtgcagatgaggaaactgaggcccagggaggaagagcgatctgtggagatatttctagaacccctgcaagctgagccccagtgaaggagagaaggtccagtaggagcttgctaagctcaaaatcgaagaaaggttcagcaagactgtcagggtgacctcaaagcaatggcagccatcagaggagccccattgctattaggaggctcctattgccctccccttcagcctctgactttcacctgtgctacccaattctggttccttcactcccattcaaaaatggaccccagaaaagccttattttgtggagtacctagttcccttttgggtttgtctcttgactgctacgggcattgccccagggcaaccatgacagtgaagatgactggccaagcttgtggactggccagcaagcttgggctgcctgagacgctttgaaatggctgccttctgagttggtcttgagggtgaagactgaccacccttctcacctgcacagtcacagtccctctcctgctggcctgactgcagctgtcctcccagctggccacctgaccagagaccaggagagaggccacagcctccagaccctccagagtcccacggaggaagaaggcttaccagagagaccctctgatgcatgagccaggccccagcccttctccctgcatccaggtgtgtttccaccgcaaaatgcctccacacaatgagcgactttggccctgcgtgggtcagcatgtggtctgaggtaaccctcaaatgcctccaccacacatctgtccacctgcacgggttcaaggtaagcacttgcccccttctctcctccagaccagtcgcctgaaattctgagcaacattccttcaagactatcatgtaacccttggtgatgctgagtccagacaggaaatgcagacttgggacccacctgtatcagcagaaagaggccttgtgccccgtttgtccgagtcccagaacggagcaaatgagaaaaccggcgagctgtcccccgaggagctgtagggagattggtttttagtataaattacaataaaattttgtgtatgtgtacagctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaaaataaagctcttttctttatcaatt

SEQ ID NO: 119574 - DNA, 2118 bp, Homo sapiens
  Payload ID: 3437
  Gene Symbol: CXorf38
  Gene Name: chromosome X open reading frame 38
  Uniprot ID: Q8TB03
  ENST ID: ENST00000327877
  CDS Start-End: 28-987
gcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctatgccaaaacttgctaccaggccaggtgtgatggctcacacctgtaatccccagcactttgggaggccaaggcgggcggatcacctgaggtcaggagttcgagaccagcctggccaacatggcgaaaccccatctctacttaaaaaaaaatacaaatattagccgggcgtggtggcatgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctc

SEQ ID NO: 119575 - DNA, 2380 bp, Homo sapiens
  Payload ID: 3437
  Gene Symbol: CXorf38
  Gene Name: chromosome X open reading frame 38
  Uniprot ID: Q8TB03
  ENST ID: ENST00000378421
  CDS Start-End: 1551-2153
catggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccagtttcagcctcagtgtcaggtgtgcgctgaatggaaaagggagattttgagacatcatgtcaacagaaatggagatgtgcactggggaaactgccggccgggccgctggcccgtggacgcctgggaggtggccaagggtcttgatctgttatccagactggagtgcagtggtgaatcagagcttattgcaaccttgaactcctgggctcaagcaatcctcctgcctcagcctcttgagtacctgggactatagcacacaccacaatgcatggctaatttttttttttaatagagatgggagtcttgctttgttgcccaggctgggctcaaacgatcctcctgcttttgcctcccgaagtgctgggattacaggaatgagccactgtacccagcctatttagagttcttattgcgagtaactttttgttctagtcccttggcaggagtgtacccttgtgattcttagcctagtaaagttgttgcatcccagtataagttgagaaatatttcaggaaagaaatacgcccaagctttcccataacaccattttgggggtctgtgccataaaattcctactaaaggcaagatcctgctagcttgaggcccttctggcatatctagtatctcccatccccggattccatctgtaactcctatgtgggtcctactcgccttgcaccatctacataataattgccaacattgatgtcctggttactagcacgtgcctagcactgtgctagtgctatacctgcattctcttatttcattctcacaatatcctttgaagtagataaggacagttatcccccatttactgataaggaatctgagggtaacttgaccaaggtcacagctggcaaatggcagagctggcatttgaacccagtttgcactccaaagcccagactcttaatataatacttccatacggaacttcctcaagtcatttagaaagtgtccacttttattttatttttaaatcttcttatttaacaactcaaccactgaaatttcagtaaggaaaagaaaaaagatgccttctagttatgctttctgtttatatgccattaagacagaatggaaagcctgttatatcatatgtatctaatagcagggataatacagcccttcagttattgcccttggccaaggtttagctgtgacagtttccctacttgcattttgggctcatgaggctttaagttgaaacctcagtgcataagagaacttcagtcatcatttggaaaatagacaagtaaccattgcctttccatctcctagagttggaagagactcaggtccccctcctccctcccttgctataggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactcta

SEQ ID NO: 119576 - DNA, 4895 bp, Homo sapiens
  Payload ID: 3437
  Gene Symbol: CXorf38
  Gene Name: chromosome X open reading frame 38
  Uniprot ID: Q8TB03
  ENST ID: ENST00000378426
  CDS Start-End: 599-1201
acgccccgcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccaggtgagcacctggctcggggccttgaccaccgcccccaccccacccctcctcatccccgttcctgtcccagacccagagcgcaagtgtcctgttccctccgcgatgcggggcccaccgcgacgtccctccctcctgggcccctcctcaccgccgccccctgtagtttcagcctcagtgtcaggtgtgcgctgaatggaaaagggagattttgagacatcatgtcaacagaaatggagatgtgcactggggaaactgccggccgggccgctggcccgtggacgcctgggaggtggccaagagttggaagagactcaggtccccctcctccctcccttgctataggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgttgcctgaagagctctcaaatcgactggaagtggtgaaggaatttctgagaaacaatgaggatcttagaaatggccttacagaagatatgcagaagctagacagcctctgtctacatcaaaaactggattcacaggaacctgggagacaaacacctgacaggaaggcctgaggtgagttcaggcagatgatggtgttaaagaaggacagaatcacctcatctctttcatgtctattctctcatgtgaggccatcatgaacacacaacaatctaatctgaagtttgcctttgtccttattgtttcaaagaaaggacactgaggtttgtgttcttcacttaatgattcttacgtctgtgaagtaattcagcatcaactccctgtttagccaaatacacctgaagtcattggtctagaattaaatgaatcagctttataacataatcaaaaagcatttctgccttaaaatgacaccattgatgcctagctcttaccatggcattaatagcaattgactagtcaatttccataaggagaacttcttaaaatgagtaactgtcttcagcattttactttttcccccctcaaataaaaaaaataaataaaacattctctttcattttaggttgcccgtcaacaaaaatcaggcatgttctgtgaaagtcagcatggcttccatctcagacatccttttctgtgcaaaaggaaaaagttaccagagtattgtacccaaacaaaaaggaatttttgttgttttgtcctggactttcctctaactctttggaactattttaatatttataaacttggggttgtataatctattgcaataaaaaatattagatactctatgccaaaacttgctaccaggccaggtgtgatggctcacacctgtaatccccagcactttgggaggccaaggcgggcggatcacctgaggtcaggagttcgagaccagcctggccaacatggcgaaaccccatctctacttaaaaaaaaatacaaatattagccgggcgtggtggcatgtgcctgtaatcccagctactcgggaggctgaggcaggagaatcgcttgaacctgggaggcagaggttgcagtgagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctcaaaaaaaaaaaaaccccaaaaactgttactactaggttggagtagcctaaggcagtagggcaaggaggtgggcccaggctggtctgtggggagctggagaatggtgactcgagtgaccagtggacaggcaggacccaggccagcattacaagcggggatgtcaggcaggagcaggggagcttctcgcttggcagctggtttatggtacacttttgaaaagtaagctcccagggcctggccctcacatgctcagtgaatatttgactgaagggtcccctcatagcttgggagtattcacaggcctaaatgttagttatactattagctaagcctggtcctttgttacgaaatttaaaaatgaaattgcaacattcttgtggaaattcaaagacatcattttctttcaacaaattcacacattcgttcatgcttcttctataccttttacccctaaagtcatccactcctgagttcctcctgctggtttcccaaactgcgcaatgactgccccatcataggcagtggtccgtggagtcggcctcactttcgcctttccccgcatctacttgtttccaaggccagtggtacttaactgggtcaagttgcctgtggaccttcaggaacagaattgccatgttcctcactgcctgcaggaaaggctccattccaagcccagtgaagatgtgtgcctatccagccgcccaccaaggatgtcatctgtagaatgggtggagggcaggggtttatttggtgtatatttttacattaaaatgcacttaatatcactttgtaaagcccagatgagtgcaaatgtgcctgtaacttcctcctttaatctgtccaggtagtatttagtctttagtcttacattttctttctccctttatttcatgaaattccttgagaaaacttcaacagtaaagaaagaaatttcattcatctcacaactcttccaaacgaggaaacttagtgaaatatttcagagcttctagatgtgaggtacaaaacttgggatcaaatggaatcttgattcactaaccaatttaagatctgacttctaattttaggaactttgggttatgaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcaaaaggtttaacaatgtatagcagctgggcgcagtgactcgcgcctgtaatcccagcactttgggaggctgagtagggcggatcacctgaggtcaggagtttgagaccaacctggccaatgtggcgaaacgctgtctctactaaaactacaaaaattagctgggcgtggtggcgcgtgcctgtaatcccagctactcggcaggctgaggcaggagaatcgcttgaactggggaggtggaggttgcagtgagccgagatcacaccactgcattccagcctgggtgacagagggagactccgtctctaaaaaacaaccccccccccccaaaaaaaaaaatgcatagcaagctgtaatgctctttgtgttttagaatagtagaggtctggaaagttgtttgcttttccccagtttttttttgctgtgttacctctgaagggaattgaggtagaggggagagttagaaggaatattcggcttttctattttatatcctcctaggtgaaatttttacaacaaacatgtactggtgtattttgaaatgtttttaaatttttgtatttcaaaataataaaatataaattcaaactgcaa

SEQ ID NO: 119577 - DNA, 974 bp, Homo sapiens
  Payload ID: 3438
  Gene Symbol: CXorf40A
  Gene Name: chromosome X open reading frame 40A
  Uniprot ID: Q8TE69
  ENST ID: ENST00000359293
  CDS Start-End: 154-630
gacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtaga

SEQ ID NO: 119578 - DNA, 1148 bp, Homo sapiens
  Payload ID: 3438
  Gene Symbol: CXorf40A
  Gene Name: chromosome X open reading frame 40A
  Uniprot ID: Q8TE69
  ENST ID: ENST00000393985
  CDS Start-End: 600-1076
gttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatg

SEQ ID NO: 119579 - DNA, 1536 bp, Homo sapiens
  Payload ID: 3438
  Gene Symbol: CXorf40A
  Gene Name: chromosome X open reading frame 40A
  ENST ID: ENST00000422892
  CDS Start-End: 528-968
attaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaacc

SEQ ID NO: 119580 - DNA, 1403 bp, Homo sapiens
  Payload ID: 3438
  Gene Symbol: CXorf40A
  Gene Name: chromosome X open reading frame 40A
  Uniprot ID: Q8TE69
  ENST ID: ENST00000423421
  CDS Start-End: 580-1056
ttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 119581 - DNA, 2411 bp, Homo sapiens
  Payload ID: 3438
  Gene Symbol: CXorf40A
  Gene Name: chromosome X open reading frame 40A
  Uniprot ID: Q8TE69
  ENST ID: ENST00000441248
  CDS Start-End: 1588-2064
agctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagagaatagcgtctcctagcagccagggcgtgcgtacgtgcgtgatgtcgtcagtgcgtgtcttcgagaatgcgagattcataatgtttgctgtctatatgcatggctgagtacgtgcctcccgcgtacgtgcgtggtgtgcatacatgcgtgattgcgcgcccacgtacgttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 119582 - DNA, 1524 bp, Homo sapiens
  Payload ID: 3438
  Gene Symbol: CXorf40A
  Gene Name: chromosome X open reading frame 40A
  ENST ID: ENST00000434353
  CDS Start-End: 568-1008
gggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcg

SEQ ID NO: 119583 - DNA, 460 bp, Homo sapiens
  Payload ID: 3438
  Gene Symbol: CXorf40A
  Gene Name: chromosome X open reading frame 40A
  ENST ID: ENST00000431132
  CDS Start-End: 371-460
ctctcagcggacacctgcctccccctgctgattctcaagagtccgcgagctcttcctgcagcttctcctcgctcagctctcccacggccctgcccacaatggctgccggtctcgaggtcccctggccttggcctggttggctggcgcgcatcagggccaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctg

SEQ ID NO: 119584 - DNA, 1840 bp, Homo sapiens
  Payload ID: 3438
  Gene Symbol: CXorf40A
  Gene Name: chromosome X open reading frame 40A
  ENST ID: ENST00000514208
  CDS Start-End: 314-754
gaccgctaacacctgtcactggccactggtttcccggagttagcggcaacgaccttgcagcctggacactagccaggcgctccctcttctcacagcggcccacgtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaaccagtggcttaactcatcatctgctgtatttgtcacatgatgtcacaaaggtggctctcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcatatggacccctcatgggtgactgccttctaggagatggtggtccctaccaggctgtttggcctgatctgtgtggtagcacccctcttttccaatccccccatctcctttctgctttggtctcttccaggtactcctaatgattggttgcatgtgctccagtgg

SEQ ID NO: 119585 - DNA, 1208 bp, Homo sapiens
  Payload ID: 3438
  Gene Symbol: CXorf40A
  Gene Name: chromosome X open reading frame 40A
  Uniprot ID: Q8TE69
  ENST ID: ENST00000423540
  CDS Start-End: 540-1016
gaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtgggg

SEQ ID NO: 119586 - DNA, 887 bp, Homo sapiens
  Payload ID: 3438
  Gene Symbol: CXorf40A
  Gene Name: chromosome X open reading frame 40A
  ENST ID: ENST00000428236
  CDS Start-End: 250-540
gtaaagaagctaagtggaagagtgtttcctcctctggccgtaaagcaggtactctctgcagcaccagctgtccccgccctactccggaccgccccaaagactccatgggatggacctgagtcagccgaatcccagccccttcccttgggcctgctgtggtgctggacatcagtgacagacggaagcaggagaccatcaagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 119587 - DNA, 1204 bp, Homo sapiens
  Payload ID: 3438
  Gene Symbol: CXorf40A
  Gene Name: chromosome X open reading frame 40A
  Uniprot ID: Q8TE69
  ENST ID: ENST00000450602
  CDS Start-End: 381-857
tgctggtatagcagctctgggcccaaaactcctgcctggtgtcctcgtcccacccttccacttactcttcctccctcccgttccttttcctccttccggttcttcgtcgaggctgccggtctcgaggtcccctggccttggcctggttggctggcgcgcatcagggccaggtaaagaagctaagtggaagagtgtttcctcctctggccgtaaagcagctgtccccgccctactccggaccgccccaaagactccatgggatggacctgagtcagccgaatcccagccccttcccttgggcctgctgtggtgctggacatcagtgacagacggaagcaggagaccatcaaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 119588 - DNA, 1067 bp, Homo sapiens
  Payload ID: 3439
  Gene Symbol: CXorf40B
  Gene Name: chromosome X open reading frame 40B
  Uniprot ID: Q96DE9
  ENST ID: ENST00000355203
  CDS Start-End: 245-721
atgacctttcctctttatcttccttgttgtgcaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatg

SEQ ID NO: 119589 - DNA, 1316 bp, Homo sapiens
  Payload ID: 3439
  Gene Symbol: CXorf40B
  Gene Name: chromosome X open reading frame 40B
  Uniprot ID: Q96DE9
  ENST ID: ENST00000370404
  CDS Start-End: 497-973
ggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcaggtactctctgcagcaccagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtag

SEQ ID NO: 119590 - DNA, 1653 bp, Homo sapiens
  Payload ID: 3439
  Gene Symbol: CXorf40B
  Gene Name: chromosome X open reading frame 40B
  Uniprot ID: Q96DE9
  ENST ID: ENST00000370406
  CDS Start-End: 830-1306
gcagctctgggcttaaaaatcctgcctggtggtctcgtcccgcccctcctcttcctccctccggttccttttcctccttccggttcttggtctaggctgcctgtctcgagctccccggccttgtcctggttggctggcgcgggacaggatccggtaaactgaacagcgtctccttgtggcaagtgcgtgcgtacgtgcgtggcgacgtcactgcgtggcttcgtgaatacgtggcttcctagcgatttggcggtgtataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 119591 - DNA, 1440 bp, Homo sapiens
  Payload ID: 3439
  Gene Symbol: CXorf40B
  Gene Name: chromosome X open reading frame 40B
  ENST ID: ENST00000462691
  CDS Start-End: 454-894
tggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattcta

SEQ ID NO: 119592 - DNA, 1129 bp, Homo sapiens
  Payload ID: 3439
  Gene Symbol: CXorf40B
  Gene Name: chromosome X open reading frame 40B
  ENST ID: ENST00000370409
  CDS Start-End: 688-1129
gaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctcagattgggacaggggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcc

SEQ ID NO: 119593 - DNA, 808 bp, Homo sapiens
  Payload ID: 3439
  Gene Symbol: CXorf40B
  Gene Name: chromosome X open reading frame 40B
  ENST ID: ENST00000483447
  CDS Start-End: 672-808
cgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagattgggacaggggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacag

SEQ ID NO: 119594 - DNA, 1715 bp, Homo sapiens
  Payload ID: 3440
  Gene Symbol: CXorf49
  Gene Name: chromosome X open reading frame 49
  Uniprot ID: A8MYA2
  ENST ID: ENST00000535490
  CDS Start-End: 1-1545
atgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgctgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaacttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtaaccagcagccgcctgtccatcccccaagaccggaaaggcagcagcagcccccgggagcccagggctgtcctcggtgcatctggctgcagagggaaattgaggaccttacacagcagctagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctca

SEQ ID NO: 119595 - DNA, 1715 bp, Homo sapiens; identical to SEQ ID NO: 119594
  Payload ID: 3441
  Gene Symbol: CXorf49B
  Gene Name: chromosome X open reading frame 49B
  Uniprot ID: A8MYA2
  ENST ID: ENST00000542739
  CDS Start-End: 1-1545

SEQ ID NO: 119596 - DNA, 2372 bp, Homo sapiens
  Payload ID: 3442
  Gene Symbol: CXorf56
  Gene Name: chromosome X open reading frame 56
  Uniprot ID: Q9H5V9
  ENST ID: ENST00000320339
  CDS Start-End: 273-794
agattgctcttgggaatcatgccgaaagtagtgtctcggtcagtagtctgctctgacactcgggaccgggaggaatatgacgacggcgagaagcccctccatgtttactactgtttgtgcggccagatggtcctagtgctgggtgagtagccgggaactgcgggggcgtctgcaaggagccagacttcgggttcttgaaggcgaatttcctctggctgtgatctgggagccacttctcaacgaagattgactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctggctaatttttgtatttttagtagagacgggttccaccatgttggccaggctggtctccaactcctgacctcaaatgatccacccacctaggcctcccaaagtgctgggattacaggagtgagccaccgtgcccagccttgccctgctttctaggagatggagttttctgaatttttctgtatttaggttttctgtactattttttgtccacttgatgcaaacttcttcagctgtgtagaaactttatgaatagatgagtgcttgagtgtctccagtctctaaagtggctgcttttattctttcttcaaagttaataacatgttgcaagatttttggacaaaatattatggtgtgtcataggaaaagcaccatgaattatatttaggtatagcaagtcagatcctttgaagtgactctgtctctgttcttagaagggttcttggaattggctgtggtttgaatctttctactgtcagaggagacccattaaaagccagaatctgcataaagctttctttacttcaaacactgaagctgtaggcgagccatcccgtatcgactttatactcaaagaaggaaaagccagattgcagtgagtgggtaggacagctcagatccaaatgaaagtagggtctcaagtaacccaagggtggccgggtacggtggctcacgcctgtaatcctagcagtttgggaggcagaggcgggcagattgcctgagctcaggagtttgagaccagcctgggcaacatggtgaaaccctgtctctactaaaatacaaaagaaattagccaggtgtggcggcatacccctgtagtcacggctacttgggaggcagaggcaggagaattgcttgaactcgggaggtggaggttgcagtgagctgagattgcaccactgtactccagcactccagcctgggcgacagagtgagactctgtctctacaaaaaaaaaaaaaaaaaaaagtaacccaagggagggagctaccctctagtcgggcagctgatactgcttccttgcatggatacatgggagggagacgttatagattaagaaatgatagcaagataaacaaaatgatttgttgggtatcttttactttacatttgttatttgcagaggagtgttgtatatatagatgttattttatgtcacactgcttcaatgatacctatatccatgtgtttgtatccatgtttttatccattcaactgtattaaaaggtgttgggacagga

SEQ ID NO: 119597 - DNA, 1089 bp, Homo sapiens
  Payload ID: 3442
  Gene Symbol: CXorf56
  Gene Name: chromosome X open reading frame 56
  Uniprot ID: Q9H5V9
  ENST ID: ENST00000536133
  CDS Start-End: 54-680
tttcggggcgaccctcttcttggcgtagagttttcagattgctcttgggaatcatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggaggtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataaccaggcctttttctaagccctagactagaggcaagcatttagatcaggaggcaaagtaatttcttgattacatagacggattcctatttatgccctagcagaaggctttacgttgtttcccattgattctcctacattcagtgaggtctttaactgagtccatttaacttgctttcttttttttttttttttttttgagataaagtcttgctctttcgcccaggatggagtgcagtggtgcgatctcggctcactgcaacctccgcctcccgggttcaagcagttctcctgcctcagcctcctgagtagctgggattacaggcatgtgccaccacgcctggctaatttttgtatttttagtagagacgggttccaccatgttggccaggctggtctccaactcctgacc

SEQ ID NO: 119598 - DNA, 3607 bp, Homo sapiens
  Payload ID: 3443
  Gene Symbol: CXorf57
  Gene Name: chromosome X open reading frame 57
  Uniprot ID: Q6NSI4
  ENST ID: ENST00000372544
  CDS Start-End: 152-2428
aaagtctttgcagcctcgctacggggcggagtcttgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgc

SEQ ID NO: 119599 - DNA, 3861 bp, Homo sapiens
  Payload ID: 3443
  Gene Symbol: CXorf57
  Gene Name: chromosome X open reading frame 57
  Uniprot ID: Q6NSI4
  ENST ID: ENST00000372548
  CDS Start-End: 110-2677
agcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaaggtaaaaaactttattcaatggattagaacaaagtctgattccggggaacagaagaatatggttattggtggatattacccctatccaccagtgccagagacattttccaagtatagtagttctattaaagttgagtcgctcttgacagctataagtgaagtcaggaaggagattgaagacttgcagtatagggaacaaaagcgcattgcaattcaggggataattactgctataaagtatatcccccatagcagtgcgactgaaagtgcctcagcatcagaaacacttcggaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataa

SEQ ID NO: 119600 - DNA, 2880 bp, Homo sapiens
  Payload ID: 3443
  Gene Symbol: CXorf57
  Gene Name: chromosome X open reading frame 57
  ENST ID: ENST00000421550
  CDS Start-End: 1-1701
aataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgc

SEQ ID NO: 119601 - DNA, 2299 bp, Homo sapiens
  Payload ID: 3443
  Gene Symbol: CXorf57
  Gene Name: chromosome X open reading frame 57
  Uniprot ID: Q6NSI4
  ENST ID: ENST00000461251
  CDS Start-End: 107-1810
aggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaaggtaaaaaactttattcaatggattagaacaaagtctgattccggggaacagaagaatatggttattggtggatattacccctatccaccagtgccagagacattttccaagtatagtagttctattaaaggtactaatgtaattgccagtccttctaaatatgtttatattttatatgtatggcttatgctatttcaattagtcatctttattcttttcttttatgggagtgatctaaagtttagcaacattcaccgataatagctttgtcttaatgcagatctaaaaatatatgtcacgtattttctatatagttttccctatatctcgcatggtgctctaaagattaatactttgatttttatcagactggaagaaaagagaaaacacagatgataaccaactggagatataggttgagtattcctaatccaaaaatccgaaatctgaaatgttccaaaacctgaaacttctttttttttttttgagacggagtctcgctctgtcgcccaggctggagtgcagtggcgggatctcggctcactgcaagctccgcctcccgggttcacgccattctcctgcctcagcctcccatgtagctgggactacaggcgtgagccaccgcgcccggcctaacctgaaacttcttgagtactgaagtgacactcaaagaactactcattggagcagttcagattttggaattttgcattagggaagctgaactgataagtataatacaaatattcc

SEQ ID NO: 119602 - DNA, 1752 bp, Homo sapiens
  Payload ID: 3444
  Gene Symbol: CXorf58
  Gene Name: chromosome X open reading frame 58
  Uniprot ID: Q96LI9
  ENST ID: ENST00000379211
  CDS Start-End: 550-1548
aaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcgattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcaatgcttaaagacatttcagctcaaataatacagagggcttggttatctcatacaaacaaaatgatatttcgactcctaaaacacgcaatttgtgcagcggaattctatgtaacacatgaaatactgaagaaagtggcccccttagaggctaagcttattaaggatcctactatgcagtgtaaaattagattcagatttagaggtgaaacgtttccacctttcatcgtgtttaaaatttttcttcatactgatggccatggttacaagtattttagtggaaaaaatgtattaatgccgtcaagtaaggcagtggatgatgcttgcaaactaatgggggaaaggaaatttcaccgtataattatggaagatgaacgtattttcccgaagtccaaagtaactgatataatggatgttgtcaccatgcaagattatgtacaatatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggggtccatacttaactgtccaacctctatatcggccctacaaacagcaaaatcaagttaaatttctgggtcgtcgatccaagcaagctcaaatgaaagttgaaaaaatgagaaaagtttatttggctaaagaaaaaaatacttctgaggtgactgaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaat

SEQ ID NO: 119603 - DNA, 516 bp, Homo sapiens
  Payload ID: 3444
  Gene Symbol: CXorf58
  Gene Name: chromosome X open reading frame 58
  ENST ID: ENST00000435707
  CDS Start-End: 1-379
tttcgcaaatgcacgaaatgcaagatcattactatcaatgcttaaagacatttcagctcaaataatacagagggcttggttatctcatacaaacaaaatgatatttcgactcctaaaacacgcaatttgtgcagcggaattctatgtaacacatgaaatactgaagaaagtggcccccttagaggctaagcttattaaggatcctactatgcagtgtaaaattagattcagatttagaggtgaaacgtttccacctttcatcgtgtttaaaatttttcttcatactgatggccatggttacaagtattttagtggaaaaaatgtattaatgccgtcaagtaaggtgacgtttcatgatgtacattttatgttaacttagctttttaacatctacatagtatctgaattgcattcaaattatacagaataagttatttcaccatgaaacagcccaccaggtaggtagtgtgtttttttttaagcaccatgtttcaaagtgtctccacttactagcta

SEQ ID NO: 119604 - DNA, 601 bp, Homo sapiens
  Payload ID: 3445
  Gene Symbol: CXorf65
  Gene Name: chromosome X open reading frame 65
  Uniprot ID: A6NEN9
  ENST ID: ENST00000374251
  CDS Start-End: 50-601
tgcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaagtaaagttgcctaaaacaaacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaa

SEQ ID NO: 119605 - DNA, 863 bp, Homo sapiens
  Payload ID: 3445
  Gene Symbol: CXorf65
  Gene Name: chromosome X open reading frame 65
  ENST ID: ENST00000438526
  CDS Start-End: 233-361
ataatcccttaactgcagtctcaggccccacccctggggatactggttatccacaactatcaacagctctctcctgcctgtccagcctgggcatcctcagcctatgaaatccatctgcctctctagtccaccaaccctataggcctatttgccccacacaaggcctctagaacaccctccttctgcatgactcatcagggcactttgtgaagagtgaggcgatcttgagggcatgttcatcttcatcaaacatggagataatcagcagtttctggtcaataccaactgtgctgtcgtcgtgttgctgtattacatccgcagtaaaacaccatcgatttgtgtgaacaaacggggaaaatgaagatgcttttcctgatgaagcccaatcatgcagagtatgccagcaaataccttacagctcgaagcacctactacgtttgtaaggtggaacgtgggccaccaggaaccaggctggagaatgcttacagagcttttgtgcctctcctcaagaatccggagccttggctgcttgttgcactgcgcatacaatgtgatgccctggagaggagacgaattcagatgcttaaaatgaaagaagccaagaaggtcgttataattgaaccccctgcgagtgtcccgtccaagcaatcaggacgatcagacaaaaagaagtccactcgcaagtctccgacctttaggaacagaccagacttcaggaagaataaaggtcgccaactcaataaaaccaccaagcaaaagaagtaatactaggtgtgaaattactggaatttaacgtgagatttctttttctagaaagactccttctcccaatatctgcactaaggcttgagtacatacgcccc

SEQ ID NO: 119606 - DNA, 1281 bp, Homo sapiens
  Payload ID: 3446
  Gene Symbol: CXorf66
  Gene Name: chromosome X open reading frame 66
  Uniprot ID: Q5JRM2
  ENST ID: ENST00000370540
  CDS Start-End: 25-1110
aatcatttgaaccaagttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaacacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatccaaaaaggtcagtgagtctaggcagggcagccttattatccaactctgaattagctgaaacttgtcaaccctacaagaaaaaacatcttgttgccaaaacttataggcctttggtcaatgatatttctgaggcaaaggagaaaaacactcaaaacctacatgtttcaagcaaagtcaagtcctcttccaggtcctttcgtaagttagattccaggaacaatgcatacggtgatcatgtgaatgacagtgatacgatgaaatattatagtgaggttgacagtgataaagttataatcattacgtgtgacagagggtacaatcaagtcacctctgaagtaaccctaaatgattaggagctcaacaaaaataaaatccaagtgtgaaagagcaaacttataccaactattttatgctcatcatcccttaagaaaccagtagagggaaaaatcactatcaagatcacccatatctgtcttggaggcgatttattttaaaaatatcaataaaatgcatgacataaatta

SEQ ID NO: 119607 - DNA, 1929 bp, Homo sapiens
  Payload ID: 3447
  Gene Symbol: CXorf67
  Gene Name: chromosome X open reading frame 67
  Uniprot ID: Q86X51
  ENST ID: ENST00000342995
  CDS Start-End: 103-1614
ggactggctgggctccacccaccttcttgctctaccagttcgcgctctcctccggcagaagtagcagctgcgctcttgctctctgggggagaacctggcgttatggccactcagtcagacatggagaaggagcagaagcaccagcaggacgaggggcagggagggctgaacaacgaaaccgcccttgcctccggggatgcctgcgggaccgggaatcaagatcctgctgcttccgtcaccacagtctccagccaagcatctccctcgggcggcgccgccctaagcagcagcacagccggttcttccgctgcagccgccacctccgccgccattttcatcaccgatgaggcctcggggctgccaatcatagctgctgtgctgacggagaggcattctgaccgccaggactgccgcagtcctcacgaagtttttgggtgtgtggtgcccgaggggggcagccaggccgctgtggggccccagaaggccactggccacgccgacgagcacctggcccagaccaagagccccgggaacagccgtcgtaggaagcagccctgccgcaaccaggctgccccggctcagaagcctccagggcggcgtctgtttcctgagcctttgccgccatcttctccagggttccggcccagcagctatccctgttccggggcttctacgtcgagtcaggcaacccagccaggccctgcactcctaagccacgcatctgaggcaaggcctgctacccgaagccgcatcaccctggtagcttctgctctccgcagacgtgcatctggtccaggccctgtcatccgaggctgcaccgcccagccaggccctgcttttccacaccgcgccactcatctagaccctgctcgtctaagccctgaatctgcgccaggccctgcccgccgaggccgtgcatctgtgccaggccctgcccgccgaggctgcgattctgcgccaggccctgcccgccgaggccgcgattctgcgccagtctctgccccccgaggccgcgattctgcgccaggctctgcccgccgaggccgcgattctgcgccaggccctgcccttcgcgtccgcacagcaaggtcagacgccggtcatcgcagcaccagcacgacgccaggcactggcctccggagccgttccacccagcaaagatcagcccttctcagccgccgctctctgtctgggtcagctgatgagaatccttcctgtgggactggctcagaaaggcttgcctttcagagcagatcaggctctcctgatcctgaggtcccaagccgtgcttccccgcctgtttggcatgcagtccgtatgcgtgcctcctcaccctcaccccctgggaggttcttccttcccatccctcagcagtgggatgagagctcctcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgtttaaacaaaa

SEQ ID NO: 119608 - DNA, 3897 bp, Homo sapiens
  Payload ID: 3448
  Gene Symbol: CLLU1
  Gene Name: chronic lymphocytic leukemia up-regulated 1
  Uniprot ID: Q5K131
  ENST ID: ENST00000378485
  CDS Start-End: 723-1088
gaaggtaaaaaaaagagggaggtctgagaaatagaaatatcagaggaaggaaataaaggagggtgagagtaaattctcttttagcattcagattccacagattccacaaatcacatttctttttttaccaactaaggaaaaataacacttgacctaacatttcattgcagttagctaaaggatgctagaaaaactatgttgcagtggtttgctctaatttcttcaggaatagagaaaagtgacaaaaagatcagagaagagaagaaaggaaactatcagaaaaatacagaattggagtaggatataacatatttgggttgaaggtaaaattttatattgtaatcttaagtatcttgctacttcagtttggtccctggaacagcagcatcagaatctgccgagggcttgttaaaaaggcagaatctcaggtcccatcccagactcactgaatcagaatataaatactgacaagatgccccgggattcatatgcacagtagagctggcgaagttccattgtagcctgtgattgttttctgcaacttagtatttctgagttttcccaaggaagaaaacccaggccttagcttctggcagacttgtgtttctcctttacttactagctgcatgactcatgagcaaggaaatcaaactttatgtgcctgagtttcctcatctataaaatggagactataataatcatctcctaggcttgttttgaggatgttcaacaaatgctcctttcattcctctatttacagacctgccgcagacaattctgctagcagcctttgtgctattatctgttttctaaacttagtaattgagtgtgatctggagactaactctgaaataaataagctgattatttatttattttctcaaaacaacagaatacgatttagcaaattacttcttaagatattattttacatttctatattctcctaccctgagttgatgtgtgagcaatatgtcactttcataaagccaggtatacattatggacaggtaagtaaaaaacatattatttattctacgtttttgtccaaaaattttaaatttcaactgttgcgcgtgtgttggtaatgtaaaacaaactcagtacagtagtattcagtacagtatttaagcccctgtacttaaacatattcctcgtaccaatgaagttacatgaaaagcaaatttgtgtgagatatcgtagatggaagtaaattagtctttatgttccccacaaattgaaatgcatttcaaaaactctgtgtgtgtatgtgtgtgtgtgacagagtgtgtgtgagagagagacagagagatacgctttggttgcctccataagctggctgctatgattaataagaccaagttttctaaagaaaatgagatcataacaaaagccctctttatgactatcttttatcaggggcaaaaaggaaagagacaaaacagcatgaaatgatgagaccaagtgatgaaaattcattcacaatgattgctttcaagagtaatttctcttgggtaattcagcagcctgttactatggctctctggagtgatagctaatgtaaatgaagcctctaaaagtggattatcctgacaagaatatactcagccaataatgcaacagaaatccattcaaagcattcgggaaaaattcaaaagaataaatattctttttttttttttaaagttaatgacctacgatccatttcttccctgactaacaagcagcaagcacttaaaaatatccagccaggatgaaatagaaacccacctgacttgttaatatttttgtttggtcccagggactcagattctaagccaaattctttgaatgatcttggcaaatgtctcgaattatttttgccaacttttctttatcttggaaaaaaagtttcatgaatgggtgtcaaaattgattagttttaaaaacctttcttgcagatacgtatggcaccctaaaactgtattagaaaaaaatttcatatctccaggcctttcattgggtcaggttggcatttcgctgccctttatgtgtgtgacaagtgaaaataaggaaagaaaaaaactcaagtgaagaaaatcagaatctgcgcagcagttcctgggcgtttcagctgcttcccacatcacctgcctcatcaagccccagcatccatctccttgctcatcttacaccctgtgtgcatgacaggcccaccattcatttatcagagcaaaggctctcccactattctggttcacccccctacttagccagatatacaagaatatctgcacggatgacctgcctcacctgggagctcagaggagctcagattccattactatcgcaccaaggacagatctcccagcaagaatgacagaaaagactaactgcccccaaaatctcccttccaaaacacagttctcttaattctcccaagaaaccagaatgtgactgctcacctctctaaggacctgaaaacaactggccatttcagctatttaaatcaactttaaaaaatccaaccgccaaaatattaaaccattttggttggaatgataacataactaacctgctgacagctgcttctgctaggtgcaaaaatggaaaaaaaaatacttctaatcaggtcaaatcactctacctttgggattctaaatttactcatattctcaaagaaatatattcagtcatagtggggaaaataggattattcctttagctcgataagcaaccagaagttcttccttcaaatcttgacatttaatcaatcagaaattgatttttggaaaactgtttcctatgaagctatctctgcctgaaggatttttcttttacaatccagactatagaaggaaattcacaacctggactttcacctccattggtcagagttttactgaccaattcccacctctgccttacacctaacggaagtttatgcctgttttctcttcacataccccaacagttacaaatggttgttattattaagcatcttttattttgtggcctctgattacatggtcccctaaattttgacctaatcacaaaagattggtaaaatttcttaacatattaataatattttgtttatgtgtcaatatcttagcatgtatcaattaagacagaggtcttaacgttctctttttgaaagagaatattaggattcagagatattaagagattctcccaggatcacagttaggtaacagagctggattttagtccaggtctgtctacagctctaacgtatatacaccctttgtataacatgtcacgaattcagcataaagggatcttcagtgatctaagtcaggggtcagcaaccttttctaaaaaggaccaaatagtaatatttcaggctttgtggaccctatggtctctatcataactgttcaaatcaccatgtagtgtaaaaggagccataagcaaaatataaactaacgaatgtggctgttttatgggatttttttttaactctttatttacaaaagcaggtggcagatcagaactcacttatgggccatagttctctgacccctgacctgagaaaatcttatatttatggacaacatttagactgtgacttgccaagtaagaacaagaagctctgtcaactgaaggtcaaggctggagttctgaaagcaaagagctgtctggtgttaatgataagtgaaatagttaaagttagaagatcccagttataagaagcacaaagaataatgaccatagactcctgaacaagaatgtctggacttctggcttaggcactcttgttgtatggtccaggccaagttacctaatctctccaggcctccattttcttatcattaaatgaagataataaaagtattttcctcagagagctgtaagaataaactgagctaacccatgtcaagcacatagaatagg

SEQ ID NO: 119609 - DNA, 686 bp, Homo sapiens
  Payload ID: 3449
  Gene Symbol: CLLU1OS
  Gene Name: chronic lymphocytic leukemia up-regulated 1 opposite strand
  Uniprot ID: Q5K130
  ENST ID: ENST00000378487
  CDS Start-End: 3-308
agatgaacaaattggggcacaacgaacttaaggaatgccttaagactgccactgattctctacagacagtgcagcctagtatctcccagacttgtacttcctatggccctgcacttggggccccactgcctggtagaaatgaagtggccttgctaacaagtttacctccaaactatgagatttcagaaggaaaaccaagagccatctctgcatatgtgagagcgggcaaaggaaatgtgacaaggagaagaaagaagacacacttgggcaatgatgatgggaagaaggaagcacaggagaaaatgtaagaaatgtacagcccatgaggaagatccaaagagaactttggccttaactaagcttcctacattctcctggagtcggtggtttatgaatgtggtgccatctggggaactgacaacccctgatgtgttcactctgctcgtcttccaggtgagagaagaagaaggcgagaaagaaagagaagttccagaatttcacaggctgagggagatggtagtaacttctgtttatgttggtttctgtttattggtttgctttttattttgaactcgtttgacttcaggttccagatttgtttttttctttgtaaacgagactttgacattgttagcaggcccatctgtttgcttttcttaaataaaatgtaaattggtttttgtttt

SEQ ID NO: 119610 - DNA, 1468 bp, Homo sapiens
  Payload ID: 3450
  Gene Symbol: CHURC1-FNTB
  Gene Name: CHURC1-FNTB readthrough
  ENST ID: ENST00000549987
  CDS Start-End: 4-1419
gcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagac

SEQ ID NO: 119611 - DNA, 1847 bp, Homo sapiens
  Payload ID: 3450
  Gene Symbol: CHURC1-FNTB
  Gene Name: CHURC1-FNTB readthrough
  ENST ID: ENST00000552941
  CDS Start-End: 1-323
actgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccag

SEQ ID NO: 119612 - DNA, 517 bp, Homo sapiens
  Payload ID: 3450
  Gene Symbol: CHURC1-FNTB
  Gene Name: CHURC1-FNTB readthrough
  ENST ID: ENST00000551823
  CDS Start-End: 1-258
ggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgct

SEQ ID NO: 119613 - DNA, 207 bp, Homo sapiens
  Payload ID: 3450
  Gene Symbol: CHURC1-FNTB
  Gene Name: CHURC1-FNTB readthrough
  ENST ID: ENST00000553743
  CDS Start-End: 1-207
ggctgtgcagtgtgcagtaagcgggattttatgctgatcacaaacaaatccttgaaagaagaagatggagaagaaatagttacctatgatcgcaaaagtagaagaaaagatccaagaggtcttcagttcttacaagttcaaccaccttgtaccaagtgtctggatgccagccgcccatggctctgctattggatcctgcacagcttg

SEQ ID NO: 119614 - DNA, 799 bp, Homo sapiens
  Payload ID: 3451
  Gene Symbol: CHURC1
  Gene Name: churchill domain containing 1
  ENST ID: ENST00000359118
  CDS Start-End: 53-379
ggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcgcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactg

SEQ ID NO: 119615 - DNA, 1023 bp, Homo sapiens
  Payload ID: 3451
  Gene Symbol: CHURC1
  Gene Name: churchill domain containing 1
  ENST ID: ENST00000551093
  CDS Start-End: 1-379
ccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgtaccatctcctatattatatcccccacctccacctcatcccccagcccccaagtcatgaggctcagtcgttgctgggagaatggtgaagaggagtcacagaacaggtggataaacttagtggatgaactgcacctaccttcctctcagacagagatttggtccccaagacttttcagagcgggtttgtgctggtcaccttcccacagaaggaagtgtgtggaggaagttgaagctgctgtggttccagacgcaggcaggtcacccctgatgctttcaacaagaggcgtgcagtgcatcgcaggacatctgctaagggccatctcagaggcccacccctggaagccacagaaaccgaaaagacccaagcacccgccaactcaacaagttactcttttaaaaatgccttgatttcttcatcagtaaaactagcaatggggcttgacctagctttgggattttagagtgaaatttcaataacaaagcaaatgtttactagggtgttttcacaggggcacatccattgggaactgtctccttggaacaaagaataagcaagtccggggagcagctggtcttgaga

SEQ ID NO: 119616 - DNA, 1521 bp, Homo sapiens
  Payload ID: 3451
  Gene Symbol: CHURC1
  Gene Name: churchill domain containing 1
  ENST ID: ENST00000551947
  CDS Start-End: 1-251
aggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgtaccatctcctatattatatcccccacctccacctcatcccccagcccccaagtcatgaggctcagtcgttgctgggagaatggtgaagaggagtcacagaacaggtggataaacttagtggatgaactgcacctaccttcctctcagacagagatttggtccccaagacttttcagagcgggtttgtgctggtcaccttcccacagaaggaagtgtgtggaggaagttgaagctgctgtggttccagacgcaggcaggtcacccctgatgctttcaacaagaggcgtgcagtgcatcgcaggacatctgctaagggccatctcagaggcccacccctggaagccacagaaaccgaaaagacccaagcacccgccaactcaacaagttactcttttaaaaatgccttgatttcttcatcagtaaaactagcaatggggcttgacctagctttgggattttagagtgaaatttcaataacaaagcaaatgtttactagggtgttttcacaggggcacatccattgggaactgtctccttggaacaaagaataagcaagtccggggagcagctggtcttgagaatctgatttgttgagatgagatgaagtaattatcaccagggagcgccaagctgccttgcagcttttccatggctgttcaagtatacagggaccatgtgtctcagctggctgctccctaaaaacaagtttccattacctaagtggacagaaggagtgacaggaagtgtagagggaagtgtgtcccctgctgaagctgggtggagttcctagaagcaaccaataagaaagagtccccaccaagccactgagtcacaaggacttggcactgatagtgggcagaactgtaacttgccggatttatgtgcatacctagagcttccccctagtactctctgggcctccagagacacctcttattctctgctcttttgcaagccttcttcaagaaggccatgggagttcccaagatgaggagtgtgggggttccctcttccttaggtacatgccatcccttttctcctggtgtgaccttggacccttcagactcccagggttctcacctttcctaatggaatatacttggtgaggctctcct

SEQ ID NO: 119617 - DNA, 2629 bp, Homo sapiens
  Payload ID: 3451
  Gene Symbol: CHURC1
  Gene Name: churchill domain containing 1
  Uniprot ID: Q8WUH1
  ENST ID: ENST00000549115
  CDS Start-End: 55-474
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaa

SEQ ID NO: 119618 - DNA, 326 bp, Homo sapiens
  Payload ID: 3451
  Gene Symbol: CHURC1
  Gene Name: churchill domain containing 1
  ENST ID: ENST00000547625
  CDS Start-End: 1-287
atggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggttgccatccaaatagcaatgcctggtgggttgaagcagtggaagtatttgagaacagtaaaagaccttgaagaggatgtatttttattttatttttaattcataaagccatctttccactgccacaactaagctccc

SEQ ID NO: 119619 - DNA, 2566 bp, Homo sapiens
  Payload ID: 3451
  Gene Symbol: CHURC1
  Gene Name: churchill domain containing 1
  ENST ID: ENST00000552002
  CDS Start-End: 73-411
ccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaa

SEQ ID NO: 119620 - DNA, 439 bp, Homo sapiens
  Payload ID: 3451
  Gene Symbol: CHURC1
  Gene Name: churchill domain containing 1
  Uniprot ID: Q8WUH1
  ENST ID: ENST00000548752
  CDS Start-End: 1-318
atgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaa

SEQ ID NO: 119621 - DNA, 3615 bp, Homo sapiens
  Payload ID: 3451
  Gene Symbol: CHURC1
  Gene Name: churchill domain containing 1
  Uniprot ID: Q8WUH1
  ENST ID: ENST00000607599
  CDS Start-End: 55-477
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatccagatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaggaattaggcaaaa

SEQ ID NO: 119622 - DNA, 633 bp, Homo sapiens
  Payload ID: 3452
  Gene Symbol: CMA1
  Gene Name: chymase 1, mast cell
  Uniprot ID: P23946
  ENST ID: ENST00000206446
  CDS Start-End: 213-623
agcatttgctcaggcagcctctctgggaagatgctgcttcttcctctccccctgctgctctttctcttgtgctccagagctgaagctggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcccaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 119623 - DNA, 937 bp, Homo sapiens
  Payload ID: 3452
  Gene Symbol: CMA1
  Gene Name: chymase 1, mast cell
  Uniprot ID: P23946
  ENST ID: ENST00000250378
  CDS Start-End: 31-774
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcccaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaaagggaagctggaactggacctgagcagcaaagtgtgtgccactcattctggtctacccttggtccctcagccacaaccctaagcctccagaagtatcctacaggtcacagaactctcaataaacctcagtgaagacaca

SEQ ID NO: 119624 - DNA, 3147 bp, Homo sapiens
  Payload ID: 3453
  Gene Symbol: CTRC
  Gene Name: chymotrypsin C (caldecrin)
  ENST ID: ENST00000375943
  CDS Start-End: 24-233
cagccagtcctgagcacctaaccatgttgggcatcactgtcctcgctgcgctcttggcctgtgcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggccacctggatccttgatttgtgcagcttctgttgcttccctcctctctggtgctgcccctttccacactatggagccaaagagagaccccactcagccagtttcccccaccctgcattagacaggtggggaaacagaggccgggagagagggccaaggaaggagcctcctggggcattaatgggaggcagggggctggggtggagagcccagggagtcctgcgtgaagccggaggggatgggagtgaaggacgcatcagacaccttccccgctccatctcacaagctgcgaacaggtgagaccctgatgaaatcactcgcttctccgatcctacctccaccgaggggcctggcaggtcctcacagccccccagcagcaggtggaagacagggtctccccaaaagcagcgtcccccaggccagagagaccaggccacaggaggatggccaaagctcagggacaaccactcctggggaaggggctccctagcagggaccccccacccccaccccgcagcacagaccccatggctgctgttggcaggggctctctgctttgagaagtgtttagtgagccagcccctgtgtccagtcctgtgctgggcatgatgagggtacaggaagaggaagagaccccagcatcatcctcaggagacatacgtttgaagaaggcaatggtttccacacagaatcacagtggtcagagctggatatgctttcattgcattagacaagtggggaaactgaggcccagagagaggaaggagttgggatagctggcaatgcctgatccaggagaagagagttctcctgaggctgacaagaggccaagaggagccagagatgagatagacccagtgtccagggagggacatgccagtgggatcagaccctgatgacaggggcagccagagatgagagagatccaatgtccagggagggacatgccagggggatcagaccctgatgataggggcctctggcctggcctgctcctgggaatgtcctgttctgtgggggtgcccccagcccagcctctggacccctcgctggagagccctcggctgcagctacctcagactggcccaagagttgtcccttttctccaccagactttgtcccctgggagtggggaccatggtgtgactcccacacccccatgatgccaaggcaagtctcaggaaagacttgacttactcaacaagcagtgggagctacagggagcccagcaccacccagacccgggaatccaggatgggggtaccccagctgtgcaggagacagaccagtaaatagatcattaaattccctggtatacatttgaaaacagaaatacagaccagaagcatagaaacaggacacctgaagcagtgtcagttggcgggaggaatccaggatggcttcctggaggtgatgatgcccaagcttggtcttaaaatttgactagaaggtacccaagtacagaacgtagtccttcttaagtttgcttaatctaaacttcattcccacctatcctcttcttttttttttttttttttttgagacggagtcttgctctgatgcccaggctggagtgcagtggcacaatctcagctcactgcaacctccacctcccaggttcaagtgattcttctgcctcagcctcccaagtagctgggattacaggcacgcaccaccatgcacagctaattttttttttttttttttagacagagtctcgctctctcacctgggctgtagtgcagtggtgccatctcggctcactgcaagctccgcctcccaggttcacgccattctcctgcctcagcctcctgagtagctgggactacaggcgccagccaccatgcctggctaattttttttttttttgtatttttagcagagacggggtttcaccgtgttagccaggatggtctcgatctcctgatctcgtgatccacctgcctcggcctcccaaagtgctggcattacaggcgtgagccaccgtgcccggccccagctaatttttttgtatttttttagtagagatggggtttcaccatgtcgtccaggctggtctcaaactcctgacctcaggtgatctgcccgccttggcctcccaaagtactgggatcacaggtgtgagccaccacacccggtctcattcccagctatcttcttttgtgtatgtctttatattgggggttataaatgctaaatgcttgctgtcctcagatcccttgtagttagggagctaattaaaatgttaattaatattacaatgttatttaagcaatgttaaataatatctaacatttattgggcacttagtatgtgccaagcactatcctataggttttacattatctcaatccccagaaacaatcccatgaggtaggttactattaacatcatgcccattttacagatgagaaaactgaggccagacagggttagtgacttcccaatgtgtgaactagaaggtagtggagccggaatccagactttagtgatctgactccagggcctgtgctcttgtccaccatgctctgctgccctgcaatgtaaaacatcctccagaaaaaaaataaataaataaaaacttccctgatg

SEQ ID NO: 119625 - DNA, 898 bp, Homo sapiens
  Payload ID: 3453
  Gene Symbol: CTRC
  Gene Name: chymotrypsin C (caldecrin)
  Uniprot ID: Q99895
  ENST ID: ENST00000375949
  CDS Start-End: 27-833
ggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggcca

SEQ ID NO: 119626 - DNA, 1721 bp, Homo sapiens
  Payload ID: 3454
  Gene Symbol: CTRL
  Gene Name: chymotrypsin-like
  Uniprot ID: P40313
  ENST ID: ENST00000574481
  CDS Start-End: 563-1357
cacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatcca

SEQ ID NO: 119627 - DNA, 580 bp, Homo sapiens
  Payload ID: 3454
  Gene Symbol: CTRL
  Gene Name: chymotrypsin-like
  ENST ID: ENST00000571605
  CDS Start-End: 11-580
atctgccacgatgttgctgctcagcctgaccctaagcctggttctcctcggctcctcctggggacagcagcggcttccacttctgcggtggttctctcatcagccagtcctgggtggtcactgctgcccactgcaatgtcaggttctgtccgtctctcgggtgagtgcctgggctgcagacacggaggaaaagtgggcagtgcaggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtatt

SEQ ID NO: 119628 - DNA, 582 bp, Homo sapiens
  Payload ID: 3454
  Gene Symbol: CTRL
  Gene Name: chymotrypsin-like
  ENST ID: ENST00000571044
  CDS Start-End: 11-582
atctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggccctcttgtctgccagaagggaaacacatgggtgcttattggtattgtctcctggggcaccaaaaactgcaatgtgcgcgcacctgctgtgtatactcgagttagcaagttcagcacctggatcaaccag

SEQ ID NO: 119629 - DNA, 952 bp, Homo sapiens
  Payload ID: 3455
  Gene Symbol: CELA1
  Gene Name: chymotrypsin-like elastase family, member 1
  Uniprot ID: Q9UNI1
  ENST ID: ENST00000293636
  CDS Start-End: 42-818
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactacgccatctgctccagctcctcctactggggctccactgtgaagaacaccatggtgtgtgctggtggagatggagttcgctctggatgccagggtgactctgggggccccctccattgcttggtgaatggcaagtattctgtccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcagtaggacttgcgatcaaaaagtaaaacacattctgaaagactattgagccattgatagaaaagcaaataaaactagatatacatt

SEQ ID NO: 119630 - DNA, 919 bp, Homo sapiens
  Payload ID: 3456
  Gene Symbol: CELA2A
  Gene Name: chymotrypsin-like elastase family, member 2A
  Uniprot ID: P08217
  ENST ID: ENST00000359621
  CDS Start-End: 26-835
cttacagaactcccacggacacaccatgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaaccaaaagaagtccctgggactgtttcagacttggaaaggtcacagaaggaaaataatataataaagtgacaactatgcaaatca

SEQ ID NO: 119631 - DNA, 923 bp, Homo sapiens
  Payload ID: 3457
  Gene Symbol: CELA2B
  Gene Name: chymotrypsin-like elastase family, member 2B
  Uniprot ID: P08218
  ENST ID: ENST00000375910
  CDS Start-End: 26-835
cttacagaactcccacggacacaccatgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaaccaaaagaagtccctgggactgtttcagacttggaaaggtcacagaaggaaaataatattatataaagtgacaactatgcaaatcaca

SEQ ID NO: 119632 - DNA, 377 bp, Homo sapiens
  Payload ID: 3457
  Gene Symbol: CELA2B
  Gene Name: chymotrypsin-like elastase family, member 2B
  ENST ID: ENST00000422901
  CDS Start-End: 1-377
tgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagacaaattataaaggcccacaaggttctgcaacgttgttcacttatcctcttctttgtccgtgacctctgctcatcacagctggaactcaccggagtttctgccggctcctccgggatctaccgcgtgatgctgggccagcataacctctacgttgcagagtccggctcgctggccgtcagtgtctctaagattgtggt

SEQ ID NO: 119633 - DNA, 887 bp, Homo sapiens
  Payload ID: 3458
  Gene Symbol: CELA3A
  Gene Name: chymotrypsin-like elastase family, member 3A
  Uniprot ID: P09093
  ENST ID: ENST00000290122
  CDS Start-End: 20-832
tcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctgcctttggctgcaacttcatctggaagcccacggtgttcactcgagtctccgccttcatcgactggattgaggagaccatagcaagccactagaaccaaggcccagctggcagtgctgatcgatcccacatcctgaataaagaataaa

SEQ ID NO: 119634 - DNA, 649 bp, Homo sapiens
  Payload ID: 3458
  Gene Symbol: CELA3A
  Gene Name: chymotrypsin-like elastase family, member 3A
  ENST ID: ENST00000374663
  CDS Start-End: 16-381
atcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtgggtgagtgaatgctccggtctggaacccaggggctcctctacttgtccctccatgacccacagccaagtctgagtaggctccaactctgagtagggacgtagggacatagggacatagggacaggggagctgagtccagcagcctgtgcccaggtcccacacactgaggattgaagccagcagagcctttaaggaccatcaccaccaaacctgtctccctacagaggggatggcagtgttcagggaggggcaggaactctgccaaggccactt

SEQ ID NO: 119635 - DNA, 357 bp, Homo sapiens
  Payload ID: 3458
  Gene Symbol: CELA3A
  Gene Name: chymotrypsin-like elastase family, member 3A
  ENST ID: ENST00000400271
  CDS Start-End: 1-228
tggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctgcctttggctgcaacttcatctggaagcccacggtgttcactcgagtctccgccttcatcgactggattgaggagggaggatagagagacatgccagacaagaggctgcctggtgggggacagaccatagcaagccactagaaccaaggcccagctggcagtgctgatcgatcccacatcctgaataaagaataaagatctctcagaaaattc

SEQ ID NO: 119636 - DNA, 897 bp, Homo sapiens
  Payload ID: 3459
  Gene Symbol: CELA3B
  Gene Name: chymotrypsin-like elastase family, member 3B
  Uniprot ID: P08861
  ENST ID: ENST00000337107
  CDS Start-End: 20-832
tcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaccatagcaagccactagaaccaaggcccagctggcagtgctgatcgatcccacatcctgaataaagaataaagatctctcag

SEQ ID NO: 119637 - DNA, 497 bp, Homo sapiens
  Payload ID: 3459
  Gene Symbol: CELA3B
  Gene Name: chymotrypsin-like elastase family, member 3B
  ENST ID: ENST00000374666
  CDS Start-End: 4-497
gagatgaggtcttgctatgttgcccaggctggtctcaaactcccgggctcaagcgatcctcccgcctcggcctctcaaagcactaggattacagcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtga

SEQ ID NO: 119638 - DNA, 996 bp, Homo sapiens
  Payload ID: 3459
  Gene Symbol: CELA3B
  Gene Name: chymotrypsin-like elastase family, member 3B
  ENST ID: ENST00000400277
  CDS Start-End: 1-543
caggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggagaaactacagggcaacaaggcaccagagtcccggacttaggaccactgtgtgtgattcaccgtgaacactggcatattaaaggctctgagaagtcctgtaggaaaggacaatttgaactttgtttgagctcatattttccaatcccatctgacctttagttcttcactgagtgcccactgggttatattctgggagccgaggccacagcagtgaacaaagcacacaaaaccccccgccccatgggggctccgttctagtgggtccatttatcatcaaacatctattaatatctctagaatgtgcccatcaggacaccatccagatgctgctgcgcttttccaggccacacagaggggacaccctccaggtgcatcctgcatgaatatcaggctcaaccgtgctttcagggtaggaagcggagggcatttgaagagtcctttcccttccttcattcatttgttgtctccttgaataaatgctgttgaaaaccta

SEQ ID NO: 119639 - DNA, 858 bp, Homo sapiens
  Payload ID: 3460
  Gene Symbol: CTRB1
  Gene Name: chymotrypsinogen B1
  Uniprot ID: P17538
  ENST ID: ENST00000361017
  CDS Start-End: 9-800
gcagcggcatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacaca

SEQ ID NO: 119640 - DNA, 581 bp, Homo sapiens
  Payload ID: 3460
  Gene Symbol: CTRB1
  Gene Name: chymotrypsinogen B1
  ENST ID: ENST00000495583
  CDS Start-End: 35-581
ctagagacttggggaccagggaggcggaggcggcatgtgccagggaggtcctgagctggcttcagtggactggggtagaaccgggagagctgcacgcaggcaggtgaggcccaggtgggtttggggcctcagcccttattcaccccactcccccccaggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggct

SEQ ID NO: 119641 - DNA, 901 bp, Homo sapiens
  Payload ID: 3461
  Gene Symbol: CTRB2
  Gene Name: chymotrypsinogen B2
  Uniprot ID: Q6GPI1
  ENST ID: ENST00000303037
  CDS Start-End: 45-836
cggggaccggcagacaggcgtcctacacccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggtgactctggaggccccctggtctgccagaaggacggagcctggaccctggtgggcattgtgtcctggggcagccgcacctgctctaccaccacgcccgctgtgtacgcccgtgtcgccaagctcataccctgggtgcagaagatcctggccgccaactgagcccgcagctcctgccacccctgccttaagatttcccattaaatgcatctgtttagaagccctga

SEQ ID NO: 119642 - DNA, 565 bp, Homo sapiens
  Payload ID: 3461
  Gene Symbol: CTRB2
  Gene Name: chymotrypsinogen B2
  ENST ID: ENST00000562106
  CDS Start-End: 1-507
gagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccgggggtgactctggaggccccctggtctgccagaaggacggagcctggaccctggtgggcattgtgtcctggggcagccgcacctgctctaccaccacgcccgctgtgtacgcccgtgtcgccaagctcataccctgggtgcagaagatcctggccgccaactgagcccgcagctcctgccacccctgccttaagatttcccattaaatgcatctgtttagaa

SEQ ID NO: 119643 - DNA, 626 bp, Homo sapiens
  Payload ID: 3461
  Gene Symbol: CTRB2
  Gene Name: chymotrypsinogen B2
  ENST ID: ENST00000562387
  CDS Start-End: 1-414
gtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatggtgaggctggccctgcccaggccctggccagggtgactctggaggccccctggtctgccagaaggacggagcctggaccctggtgggcattgtgtcctggggcagccgcacctgctctaccaccacgcccgctgtgtacgcccgtgtcgccaagctcataccctgggtgcagaagatcctggccgccaactgagcccgcagctcctgccacccctgccttaagatttcccattaaatgcatctgttta

SEQ ID NO: 119644 - DNA, 560 bp, Homo sapiens
  Payload ID: 3461
  Gene Symbol: CTRB2
  Gene Name: chymotrypsinogen B2
  ENST ID: ENST00000567767
  CDS Start-End: 1-345
gacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgggtgactctggaggccccctggtctgccagaaggacggagcctggaccctggtgggcattgtgtcctggggcagccgcacctgctctaccaccacgcccgctgtgtacgcccgtgtcgccaagctcataccctgggtgcagaagatcctggccgccaactgagcccgcagctcctgccacccctgccttaagatttcccattaaatgcatctgtttagaa

SEQ ID NO: 119645 - DNA, 9766 bp, Homo sapiens
  Payload ID: 3462
  Gene Symbol: CFAP54
  Gene Name: cilia and flagella associated 54
  Uniprot ID: Q96N23
  ENST ID: ENST00000524981
  CDS Start-End: 24-9314
caggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaataccaattttgatgagaataaagtggatgtaactcaattcaaagctacctttttcccaaaaggctttaaagataaaactgctggacttacatttcatgctttgagtggcaaaaatatgtgcaactaccagctggtctgcgacagtgatgaaaacctgaagaataaagaatctgtggtccagtgtctgcatatcttgtcctccttaaggctcatcatgcaagtggctctgccacaagagcatctttgctggattatcttcaatggtaccatttatatttacaccatttgcagaaaactgatggtcataggtcagtcttccaaggccttagagtatctcctgtgggccagcatgtgtatggagtccttggtcccgctcctgtcactcaggtacttgacatggcgcgctactctctacacagctgtttgccagtgctgctatgactgccatgccgggattcacggagaggcatttgctcggcgtgctttggctaaaattgatgagttaaggcaactggaattaatgagttcctcaaaatcccaggaagaatcgcgaagatattttcgagaggccacaatgaagatggcagtgatgatcttcaaaagaggagtctttgaatctagaagaaaaaacaaagctgtctttagacctaagataagaattaacctaagggaagtacaaactttatcatggccacgaactgtcacagagcggctactggatgagatgtttgatagcactgcatcccagtttctggctgtcttggaagctctttctgattcaaataggcgaatactgcaaactggacccattgttacagatgaagtggagattcatgatgttgtctcagaattgtttatggcaggaaaagaacttttgataatgtcaaatattggtgcagatggaatgcttgattttccaaaaacatctcttctggaacttatgataggaagaaaagatgttatttctgtggatgctgctgtgaaatttataaaattagcttttacctatgaggagtggagtttatttgaatcttctgctgtacatcttatttattttctccagaggcaggatgatccagagtcaaagaaagcagagaaggatttaactcttctgattgcaatggaaccactaatcaacgtgaagagaaacaaaggtttgatctttcctttggaaaactataaagaaggacagtcaactcaaatttatttaaaaaaaattgctgttcatgatacttgtttgaagacttgtggatattcagaggatattttccatttggcagcaaccttgtatgtctgtgtctgcactgctccccaggatgttcaacctgataaagaaattgttgtggacacgataatgttcctatggcagaaatgcaaattaggaattcagcggctcaatatatccagaaatgactatgcaaaattcacccagaaaatcagtactaacaaatggatttatcttctgtggcagataaatgaagtaattcactgctataaaatggaagacattgacattgtggtagtggcagaagtcacattacggttaagtgaaatattggaatctttaggaagcccaggaagaaaatttaaacaatctctagatgtacctttaagagaagggactaacaaattccctggagctccaaaagggatcacagaaattcttccaatattacagaaaaatcctgtggaacagttactttttgcttataaacttcttgacagagcaatcggtggaataaatttgaattgcatgttaacctctttgccaaatggatcatcagtaattgaccactgctatgccaagcgtacccaccatatagatggagatacttacaaaccacttgcctcaaatagtttcatgatggatttgcatcttgaactaattcaagctcagcatcgaatagctgttgtgcttctggacaaattgcaagttttgcagactccaactgttagcaaagatatttctaccaagggtccggaaaagttaaaacaatctggaagcactgattgttttacagaattaaatataatgaataaaataaagaagaatacattatccaaagcaatttacttaatgcagaaagctcttttaatattcgagaaagatgcaacttctacatcttcatgggaacttttgatggaagcatattccttaattcagaggattgaagctgaacaaaatgccctatattcctatcagaaatatttggaaagttcaaaaagaaagaaaagcagagtcccccctccacctatcctgctgtctcgaactcattgttctgtgacactcaaacctgctccatttacttcagaggttaaggtctcctggtactgcattttgggttgcaaagcagaaggaagttatggaaaagtacggctaaacaataatcatctcccaaattcaggagaagcgataccagctgacggtaaaagtgtttttgaagtgaaaggtttagaaaccaatgaaaagtatgtatttgcagttgctgcctattctaacaacggaaagcttgtcggtggtgctattggggagacaactaaaccaattctggtttatccccctctttctactattactgctcggatgttcctgacacaggttgcctatcaagttggtaactatgaattggctaagaaagttttctcaccagtttgggattattttgttgcttcgccacttcaggatgaacaatctgttatttgtttaagcaatataattactattacacaaagaagattacattcagatattttggcagagacttcttcaatcctcttgtacctttttcttagaaatatttttgtaacaagtgacatcaaaattaaagaagaaaatcttttctgtgataatattaaaggcaatgagattttcccatctcaacaaattgccagactgattgaatgtgagagagtattagtggcattggaacttagcaacttcctaaatgattccagctatgcccttcaagctgtgactcaatgttatggacttcttgctcccataatttatcacaatattgttttggtacctgttgtacagatcctgataaagtgtatagtggttttgcaaggactaccaagtattgtctgctcgaagaaacatactgcgagctttgaaagtatacaacacatgatagcttgttgtattttctacataacaaagattcttcgttcatggagggaatatgacctggcagtaatgattataaattatgggaaaaaaatgttggacatcacaccaggatgcaagtctctgtttgatggtagtaatgaacaagaagaaatgccagaggaggattcttctaagaagtctttaaagactaagaagccacagcagatactactgcctgaaaagataaatgaacagctggccttgttggagacacacctactcaaactgacaaagcaatatgttacatctgaactctcaggaggagaggaccctatatttctttatcctgtagttttgaattggtcggtcaaaggtgccgtgaaagaagttatgaaatttaagcaaaaaccaagatttctggaattctttacacaagttatgctaaaatgcatgaatgaggaaaaatttcatcttatggtagaggtaacaactcctgtccatgacttcttgaaaaggagaaatgagtctctacttggactaataaaagtgaaatataaggatagtgctttgaataaaaaagcaaacaaatctttaaagttcaaagctgcagtaatggaaattggaagaagtgcagaaatgcaacaaagaataagaagtaaaaaaaaggaaactctaagagatttcatttttaaaaatccggctatttctgaaatggtggcacatgaaagaaataggagaaccagtgttaggaaagcagcacaacgatacctgatggattacttgaatcctctaatattaagttatgttaaaagaaagaggttccatcgtctatcacttgaagagatgccctggagagctcagatgaacctgtatctagcaggtgcacactttaacctggttttacaaaagctatgggagtgtacgaagatgaaatttggcacatcacatatgatggtcagtttccgatcatgtgatcctaacatgttttcactgtataattcaggaacagtattaccaacaagaaaattgactgtagaaaattataaagcaatgcttgatttccttcttacagccaaaaaaagaaaggccaacttaccatcagatgctgaagaattttctacatttattaattccataatgagtgatgaaaatatgtccaagacacaaacagtttatgactcagactctcaatcaggttctagtgctaaagaaaaggaccgaggagcaaatttgtgtgtaatggatcattttatgaaaatctttttatactgcaggagagcaatggttcttgctcatcgtggtggctattggactctgcttcagaactgctgtcgggccttatggaactttactcaggaactacaaatacttcttaaacaggcagtggatcttgataaaacatttcctattagccaagatggtttcctctgcacctctgttttaccattctatttgggagcagaattacttattgacatgttaatacaactacaaaataccagttctattaagcctattgaagacaaaggagaattcagtgttccaagctgttatgggaatattaaaaatgacaacggtggttctagtcttacctttgagcatcctttggatgatgtaaatgtggttgatttgaaatggatccacgactttgtattaaaatctctggaagttttatatcaagtggaaaaatgggaaacactagtatctcttgccattcagttcaatacagtttcacatgagaggtatacagaacaagtgacaccacttctggtgtatgcacagcgccagcttctgctgagaatacagaagttcaagggcccagatattacccaacaaccttgtgcaaggtatgaggctgaatatggagagaagataacttgccgaaatttcattgggaagcagcttaagattaattcttcaaccattgaagcaacaagcaactgcacagatttgctaaaaatgcttatctcttcagaatacagccgagccaaagcgcttgtctgcgtgcccgtggacgtgacagacaccttgaggtgttttagagagacactggaaaaatccaaataccataacagatcaatccgacacagcagaaagttgctttcattatttcttgcacagacacaagatgttctccaagccagcaatcaaagaagtcttaaagttcaggcgttgcattcacttggaagtcttctcatcttcgcagaaaagaaaagggctgcttttaagtgttggtgtcaagctcttgatgacatattcagaaaaccagacgtgctacacacgtggaaagaatttggcccctcactcaccaatgtcaccaacagtcattcacctccgggtttcaaagactacagtgaggagtttctgtcaagagttggcatctgggggtgtttgcaaggagcagtcatatcagcaaagatagcacaatttattaagtcattgaatgttgaaaagaaaactgactgttgcattttgtctgcgttactctttcagggtttgcttagaacaacacttccacatcccaaagctgaacgttgctatgctcaatatgaaatcactcagcttctcccaggcattgaactcttctcagatagatacagggctgacatttgctctgtaattgcaagtctgtattacattatacgtgaactgcactttgttaggcaaaacctaatagttctgcctctccttgcattgtatcaatattttgtttctggaatttgtcaagacataacaagaaatctagaagcaagaatcctcaagatagaagtccttatagatttgagattcttttctgaagccttttatgagatatcccaaattttctatggaaaaaacatgccttgtccaatacctgcaggctataaagccactggaaaaatgaagatctttcaatcatttgactcaggaaaacttcttaccagtaaagaaaatatacaggcaattgatgaattaagaaataaaggcttgcctgcagttctggttacaattggccaaccacatctcttaaataagtttaattttgttaaagcatactttttcctaagtgtggctgcgacaataaattgtgtcccagaaaataaatttaagacagtaattaccaacaagagcaaaccaaacctaccaaacttggaagagatatattcaaaggatgatggaagttcattttataatcttacaaaacttaaagatgagatcactcttagcatgctaaagtcgatgttactgatggaagctgaggacaggctaaacttccttctgtccgaggtggaacagaagaccctgtctcagtgctccgctggcgagctggagattgtggtggaggcccggcttcagctggctgcagttgctctgcagaggcaccgggcggcatacagtgctgcaatagtattttctacacttacacttctccaggattcaaaactttttgaaaagaaggtagtacaggatgacacagagaatcctgtctctccaggaacttctgtcactgaaaataaagatgacagtgagtttttagatcctatttccctaaatgcccgagaatatttcaacattcatctgtggttgaggtgccgcttagcattggtgactgcatttgttgcacagattcatggcattggaattgtgaaagaggatgatatgacagattgcctgagcctcatcaatgaagtgtgtatggaggcaaaaagcgcaggggacacggaactgcaggctgaattcttgacgcaagctgtaattcttggcctacaagaaaagcatttaaaggcagacatcatgacaaaccttcaggatataatacatttgctggaaggaaatgaatttatttctcctcaatcacggctaaccctggcaagaagcctagttttgctggatgacttaaccaaagctgagaaattcaaggaatctccctcttcaaaaacaggaaaattaaatttgttaactcgggctcatagcattctaactgaacagatgctagcttttggagaaacaattgaatttcgttcatcaaacactaaatatgcaaatccattacagcctttgaaaaatatctatcttccccatgtcatgttattggccaaaataaaaatgagaattggacatacagtggccaagcaagtatattacaagaataaaaggaaggacccctcgaagtggttacctgctcttcatctgtttgatgtggcactgaagctctgtagaacaacagcagtggaggaacatgaggtggaagctgaaatcctttttcagaaaggcaaaatagaacgtcaaatactaatggaagagaaatctccaagttttcaacttgagagtttatatgaagctatacaactaagcctgaaaaatgatcaaaactcaggattgataagagactcctacctagaaatggctctattgtattttcatctgaagaagccaaagataaaaatttcaggatcaccattaacacttaagcctcctctcagaagaagtagttctgttaaagaaacatcagcaaataaatttgaaatgtacagttcattagcctggattgcaataagagctgctgcacaggtcagtgaagctgtgctggcaattaacttacttattggaaagaagaatactagaatgcataaagttaaccaagtggcattaccaaatatcccagaatttgctgctctggatcttttgtcttcgtatacagattatttgcttgacaactaccaagtcctcttccagacttcctgtacatttttgtaccaaaatgatgatgtgtgtgacagcgcagatggtagaaaaaagactcagaccaaagtggatattacatggatccttctactgcgctactatattcaccttcagaggattaataatctgagcaaactgctagcatctgcaacaccagtatctggaatttctttgccagatgatacacttctcacatccctttacaactctgagttgattttgcgccagaaagaagtgcattttttccttaaaaaattcttacagctgtattcttcttcttgtattgatgaatttccaaaagaacttctttgtcaactggaaaatccccctctttcagaaaaagacttacgtgaatcatctgccaagttgtatcgcgatagttctgtacaatccattttatcttttaagcctgtttcaggctcatcttgtgtggacataacgccaatagaaatggtaacgcaagcttcaaacaaagaactttgctttcaatggtacattcctcccctggatagacctcccaaggagacagaacctatggttttattgttgtatgcatataatttgaagcctctgaagatttcagatgttagacattccacttataacagtacatgtgttggctctttatggattccactgaatagggttattgcaattcatgagaaattatctaatcttgctcaaatagctgaactatcattgccagcagctcctgaaattacctcaaatgaaaacatatatgaagtagaagtggaagaggaatcagttgataatgaaatggaagacatgattattcaatgttgctctgaaatagcatctctgtttttgaatgataaagagccaacaccactatctgaggtcccatttgatatctcactgccgtctatattcaatcttgagagactttttgatctggctaatggttgcattttatcaggaggaagccttttcaactggatagtgtcaattattccctgaatatcctatacacgggatgataaaactgagaaataaatcaagagtatgacaacagactgaggaatttttcagcaatatctgtcagcctttggaaatttggtgagaagaagtagtcatgattcaatgtcttgcttgcacagaagcctctagttcaaacttggatcttgccccatctgatttcttatgatatatacaaatactctagatattgctttgagatttcgctgttgatcaactggcctgctgcagcttcataggtgtttcagctcccagtagggcagtttaactcctatcttctctgtgagttccaggtctgtatatctcctcagctcgctctcatttgtccagcttatctatttctttatcaagttgctttggcttccccactctctcctgcgttttgaaaagaattaattctcaagtagattaaaactacattctggtaaaaatga

SEQ ID NO: 119646 - DNA, 2756 bp, Homo sapiens
  Payload ID: 3462
  Gene Symbol: CFAP54
  Gene Name: cilia and flagella associated 54
  ENST ID: ENST00000550977
  CDS Start-End: 1-796
gccagaggaggattcttctaagaagtctttaaagactaagaagccacagcagatactactgcctgaaaagataaatgaacagctggccttgttggagacacacctactcaaactgacaaagcaatatgttacatctgaactctcaggaggagaggaccctatatttctttatcctgtagttttgaattggtcggtcaaaggtgccgtgaaagaagttatgaaatttaagcaaaaaccaagatttctggaattctttacacaagttatgctaaaatgcatgaatgaggaaaaatttcatcttatggtagaggtaacaactcctgtccatgacttcttgaaaaggagaaatgagtctctacttggactaataaaagtgaaatataaggatagtgctttgaataaaaaagcaaacaaatctttaaagttcaaagctgcagtaatggaaattggaagaagtgcagaaatgcaacaaagaataagaagtaaaaaaaaggaaactctaagagatttcatttttaaaaatccggctatttctgaaatggtggcacatgaaagaaataggagaaccagtgttaggaaagcagcacaacgatacctgatggattacttgaatcctctaatattaagttatgttaaaagaaagaggttccatcgtctatcacttgaagagatgccctggagagctcagatgaacctgtatctagcaggtgcacactttaacctggttttacaaaagctatgggagtgtacgaagatgaaatttggcacatcacatatgatggtcagacatttttaagcacttactgagtgtctttggctaagtgctgtgagagataaaaatagaagatacatacataatatggaatactgtgtagctattaaaaagatacaaaatcaatgagcaaaaagcacaagcattcttatacaccaataacagacaaacaaagagccaaatcatgagtgaactcccattcacaattgcttcaaagagaataaaatacccaggaatccaacttacaagggatgtgaaggacctcttcaaggagaactacaaaccactgctcaatgaaataaaagaggatacaaaccagtggaagaacattccatgcttagggataggaagaatcaatatcgtgaaaatggccatactgcctaggtaatttatagattcaatgccatccccatcaagctaccaatgactttcttcacagaattggaaaaaaactactttaaagttcatatggaaccaaaaaagagcctgcatcgccaagtcaatcctaagccaaaagaacaaagctggaggcatcacgctacctgacttcaaactatactacaaggctacagtaaccgaaacagcatggtactggtaccaaaacagagatatagacaaatggaacagaacagagccctcagaaataatgtcacatatctacaactatctgatctttgacaaacctgacaaaaacaaaaaatggggaaaggattccctatttaataaatggtgctgggaaaacttgctagccatatttagaaagttgaaactggatcccttccttacaccttatacaaaaattaattcaagatggattaaagacttaaattttagacctaaaaccataaaaaccctagaagaaaacctaggcaataccattcaggacataggcatgggcaaggacttcatgtctaaaacaccaaaagcaatggcaagaaaagccaaaattgacaaatgggatctaattaaactaaagagcttctgcacagcaaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaagtgggtgaaggatatgaacagacatttcacaaaagaatacatttatgcagccaaaagacacatgaaaaaatgctcatcatcactggccatcagaaaaatgcaaatcaaaaccacaatgagataccatctcacaccagttagaatggcgatcattaaaaagtcaggaaacaagaggtgctggagaggatgtggagaaataggaacacttttacacggttggtgggactgtatgtaaactagttcaacctttgtggaagtcagtgtggcgattcctcagggatctagaactagaaataccatttgacccagccatcccattactgggtatatacccaaaggattataaatcatgctgctataaagacacatgcacaaatatgtttatcacagcactattcacaatagcaaagacttggaaccaagccaagtgtccaacaatgatagactggattaagaaaatgtggcacgtatacaccatggaatactatgcagccataaaaaatgatgagttcatgtcctttgtagggacatggatgaagctggaaactatcattctcagcaaactatcgcaaggacgaaaaatcaaacaccgcatgttctcactcataggtgggaattgaacaatgagaacacatggacacaggaaggggaacatcacacaccggggcctgttatggggtggtgggagtggggaggtatagcattaggagatatacctaatgttaaatgacgagttaatgggtgcagcacaccaacatggcacatgtatacgtatgtaacaaacctgcacattgtgcacatgtaccctaaaacttaaagtataataataaaaaaagaataatgaatataa

SEQ ID NO: 119647 - DNA, 1967 bp, Homo sapiens
  Payload ID: 3462
  Gene Symbol: CFAP54
  Gene Name: cilia and flagella associated 54
  ENST ID: ENST00000553778
  CDS Start-End: 36-1967
gtacacatactccaggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaatttcatgctttgagtggcaaaaatatgtgcaactaccagctggtctgcgacagtgatgaaaacctgaagaataaagaatctgtggtccagtgtctgcatatcttgtcctccttaaggctcatcatgcaagtggctctgccacaagagcatctttgctggattatcttcaatggtaccatttatatttacaccatttgcagaaaactgatggtcataggtcagtcttccaaggccttagagtatctcctgtgggccagcatgtgtatggagtccttggtcccgctcctgtcactcaggtacttgacatggcgcgctactctctacacagctgtttgccagtgctgctatgactgccatgccgggattcacggagaggcatttgctcggcgtgctttggctaaaattgatgagttaaggcaactggaattaatgagttcctcaaaatcccaggaagaatcgcgaagatattttcgagaggccacaatgaagatggcagtgatgatcttcaaaagaggagtctttgaatctagaagaaaaaacaaagctgtctttagacctaagataagaattaacctaagggaagtacaaactttatcatggccacgaactgtcacagagcggctactggatgagatgtttgatagcactgcatcccagtttctggctgtcttggaagctctttctgattcaaataggcgaatactgcaaactggacccattgttacagatgaagtggagattcatgatgttgtctcagaattgtttatggcaggaaaagaacttttgataatgtcaaatattggtgcagatggaatgcttgattttccaaaaacatctcttctggaacttatgataggaagaaaagatgttatttctgtggatgctgctgtgaaatttataaaattagcttttacctatgaggagtggagtttatttgaatcttctgctgtacatcttatttattttctccagaggcaggatgatccagagtcaaagaaagcagagaaggatttaactcttctgattgcaatggaaccactaatcaacgtgaagagaaacaaaggtttgatctttcctttggaaaactataaagaaggacagtcaactcaaatttatttaaaaaaaattgctgttcatgatacttgtttgaagacttgtggatattcagaggatattttccatttggcagcaaccttgtatgtctgtgtctgcactgctccccaggatgttcaacctgataaagaaattgttgtggacacgataatgttcctatggcagaaatgcaaattaggaattcagcggctcaatatatccagaaatgactatgcaaaattcacccagaaaatcagtactaacaaagtattcctttcgcattccctttcacgtgttttttttgctattgcttattcaagttgccacacacatttcaaatctaaatttttcctatttttcacctggttaatgactttcatttgcatatatacatatataaagaagatattctttcta

SEQ ID NO: 119648 - DNA, 2086 bp, Homo sapiens
  Payload ID: 3463
  Gene Symbol: CFAP100
  Gene Name: cilia and flagella associated protein 100
  Uniprot ID: Q494V2
  ENST ID: ENST00000352312
  CDS Start-End: 100-1935
agcgcggaggcttcggagcgagccggggcagtcggggtcggtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgaacggcagcagcagaagacgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagaaaagaatgtggagcctgagaacatgagtggctacattaagcagaagcggcaaatgttcctcctccagtatgccctggatgtcaagcggagagagatccagcggctggagacgctggcgaccaaagaggaggccaggctggagcgggccgagaaatccctggagaaggacgccgccttgttcgacgagttcgtcagggagaatgactgcagctccgtgcaggccatgagagcggctgagaaggagaccaaagccaagatagagaagatccttgagatccgggacctcaccacccagattgttaatatcaaaagtgagatctccagatttgaagacactctgaagcattacaaggtctataaggatttcctatacaagctgtcgcccaaggagtggcttgaagaacaggaaaagaaacactcgtttctcaaaaaggccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtcgaactctcccatcccccccacgcaggaggacaccgacagcgatggggaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatggacagggaggtcaaccagctgaagcagtgggtcaccacaatgatgatgtccatcaccaaggaggaggacacagcagctgagctggagctcaaagcccgagtcttccacttcggcgagtacaagggcgatcagcaggataagctgctagagagcctgaactgcaaggtgctggatgtgtaccggcactgcaccggcacccagcaggaggccaacctgggcaccgtgcagatgctgaccatcattgagcaccagctggatgagctgctagagaacctggagcacgtgccccaggtcaagatcgagcaggccgagagggcaaaggagaaggagcggcgcatcagacttcgagaagagaagctccagatgcaaaagatcctacaggaggagcatctgcagcgggcccgggcgcgcgcccaggctgagatcaagaagaagagaggcaggacactggtatgccgctcacgacccccagcccacaggatcaaacaacagtctgagcacacactgatggacaaggaggaggaggagctgctatttttctttacttaatcttcgcagaccatagctgttctggctgaaggcttagcaaagatgttggcagaggaagcagagactgggctgggtctcgagtggcccaactgagtcctctctgtctcctgtgtgctcccttcctcacctgaataaattcatgtctctctgg

SEQ ID NO: 119649 - DNA, 1994 bp, Homo sapiens
  Payload ID: 3463
  Gene Symbol: CFAP100
  Gene Name: cilia and flagella associated protein 100
  Uniprot ID: Q494V2
  ENST ID: ENST00000505024
  CDS Start-End: 30-1868
ttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgaacggcagcagcagaagacgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagcagaaaagaatgtggagcctgagaacatgagtggctacattaagcagaagcggcaaatgttcctcctccagtatgccctggatgtcaagcggagagagatccagcggctggagacgctggcgaccaaagaggaggccaggctggagcgggccgagaaatccctggagaaggacgccgccttgttcgacgagttcgtcagggagaatgactgcagctccgtgcaggccatgagagcggctgagaaggagaccaaagccaagatagagaagatccttgagatccgggacctcaccacccagattgttaatatcaaaagtgagatctccagatttgaagacactctgaagcattacaaggtctataaggatttcctatacaagctgtcgcccaaggagtggcttgaagaacaggaaaagaaacactcgtttctcaaaaaggccaaggaggtctccgaggcttccaaagagagcagtgttaactccacaccaggggacaaaggaccagggatcaagggcaaggcgagctccatgtgggccaaagagggtcagggtacaaagaagccctggaggtttctgcagacgatgcggctggggcggagcccgtcttacctgagcagcccccagcaaggcagccagcccagcgagtccagcggtggcgactccagagggtcgaactctcccatcccccccacgcaggaggacaccgacagcgatggggaggaaccacagctgtacttcacggagccccagcagctcctggatgtcttccgagagctggaggagcagaacctgtcgctgatccagaacagccaggagacggagaagaccctggaggagctgagccacaccctgaaacacacccagatccgcatggacagggaggtcaaccagctgaagcagtgggtcaccacaatgatgatgtccatcaccaaggaggaggacacagcagctgagctggagctcaaagcccgagtcttccacttcggcgagtacaagggcgatcagcaggataagctgctagagagcctgaactgcaaggtgctggatgtgtaccggcactgcaccggcacccagcaggaggccaacctgggcaccgtgcagatgctgaccatcattgagcaccagctggatgagctgctagagaacctggagcacgtgccccaggtcaagatcgagcaggccgagagggcaaaggagaaggagcggcgcatcagacttcgagaagagaagctccagatgcaaaagatcctacaggaggagcatctgcagcgggcccgggcgcgcgcccaggctgagatcaagaagaagagaggcaggacactggtatgccgctcacgacccccagcccacaggatcaaacaacagtctgagcacacactgatggacaaggaggaggaggagctgctatttttctttacttaatcttcgcagaccatagctgttctggctgaaggcttagcaaagatgttggcagaggaagcagagactgggctgggtctcgagtggcccaactgagtcctctctgtctcctgtgtgctcccttcctca

SEQ ID NO: 119650 - DNA, 481 bp, Homo sapiens
  Payload ID: 3463
  Gene Symbol: CFAP100
  Gene Name: cilia and flagella associated protein 100
  ENST ID: ENST00000510833
  CDS Start-End: 93-446
tcattcaatggatgaagttaagaagtgccaagggtgaggatctcctttagaagaggagaagccttgcatcaacctcttgggcctcagccaagatgtctgagataccgtccactatagtctccaagaacatgaccaatgacaagaacagcctggaatccatgaacatcagctcttcttcaagcactgaagagaacccaaagaaacaggcaagaaaaaacgaagaacatggtcctgacccttcagcgaaccctttccacttatctggggatgtggatttcttcttgctcagagatcaggagcggaataaggctctctccgtgagtatccaggacagacgccagcacctccgggagcttccctgctcccactgcttcctggagtggccacattgcccttctcagaggagcactttcctcaggtccttctcattccagaatagtcaatagctcaccacttactataaaatcagctggaaacctta

SEQ ID NO: 119651 - DNA, 774 bp, Homo sapiens
  Payload ID: 3464
  Gene Symbol: CFAP126
  Gene Name: cilia and flagella associated protein 126
  Uniprot ID: Q5VTH2
  ENST ID: ENST00000367974
  CDS Start-End: 7-540
aagatcatggccactaactacagtgccaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatctttta

SEQ ID NO: 119652 - DNA, 1721 bp, Homo sapiens
  Payload ID: 3465
  Gene Symbol: CFAP157
  Gene Name: cilia and flagella associated protein 157
  Uniprot ID: Q5JU67
  ENST ID: ENST00000373295
  CDS Start-End: 41-1603
ggcctcttcctggggcctggagccctggttgccatcagccatggctcccaaaaagagtgtgagcaaggcaggcaaggagcttgaagtcaagaagaaagggggcaagaaggagccggtggtggccgtggagccgcctctggccaaggagatgaaggagttctaccacatccagatccgagacctggaggaccggctagcccggtaccagcggaagtgggatgagctggctgtgcaggagaagatgttccgccaggagtttgagcagctggccaataacaagaaggagattgtggccttcctcaagcgcacgctcaaccagcaggtggatgagatcacagacctcaacgagcagctccagaacttgcagctagccaaagagatggagaaggatgccttcgaggcgcagctggcccaggtgcgccacgagttccaggagaccaaggaccagctcaccacggagaacatcatccttggggggaagctggcagccctggaggagttccggctgcagaaagaggaggtcacggacaagttcacattgctggaggagcaggtgcggaagcaggagaatgagttcagggactatgcatacaacctggagaagaagtcggtgctggacaaggacagactgaggaaagagatcatccagcgcgtgaacctcgtggccaatgagttccacaaggtgaccacgaaccggatgtgggagacaaccaagcgggccatcaaagagaacaacggcattaccctgcagatggccagggtctcccagcaaggcatgaagctgctgcaggagaatgagcagctcaagggaagacagaacaatctgtgcaaacagctggagctgctggagaacacccagaaggtcatggccaggcacaaaagaggccaccagaagatcatcctcatgctgactaagaagtgccaggagcagcagcaggacaccaaggaggccgaggagctgcgcctcctgctgagccagttggagcagagatccctgcagctgcaggtggataaccaggcactgaagagccagagagaccagctgagcctgcagctggagcagcagcaggtggatttgcagcggctacagcaggaactggctaatgagcagaaggttcgggccagcctggaggcggctctggtccaggccacctccttcctacagaacattctgcagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatatatcacccgtgtggggaccttccgggcacacagcagccctgagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagataccaa

SEQ ID NO: 119653 - DNA, 1796 bp, Homo sapiens
  Payload ID: 3465
  Gene Symbol: CFAP157
  Gene Name: cilia and flagella associated protein 157
  Uniprot ID: Q5JU67
  ENST ID: ENST00000614677
  CDS Start-End: 14-1291
gttgccatcagccatggctcccaaaaagagtgtgagcaaggcaggcaaggagcttgaagtcaagaagaaagggggcaagaaggagccggtggtggccgtggagccgcctctggccaaggagatgaaggagttctaccacatccagatccgagacctggaggaccggctagcccggtaccagcggaagtgggatgagctggctgtgcaggagaagatgttccgccaggagtttgagcagctggccaataacaagaaggagattgtggccttcctcaagcgcacgctcaaccagcaggtggatgagatcacagacctcaacgagcagctccagaacttgcagctagccaaagagatggagaaggatgccttcgaggcgcagctggcccaggtgcgccacgagttccaggagaccaaggaccagctcaccacggagaacatcatccttggggggaagctggcagccctggaggagttccggctgcagaaagaggaggtcacggacaagttcacattgctggaggagcaggtgcggaagcaggagaatgagttcagggactatgcatacaacctggagaagaagtcggtgctggacaaggacagactgaggaaagagatcatccagcgcgtgaacctcgtggccaatgagttccacaaggtgaccacgaaccggatgtgggagacaaccaagcgggccatcaaagagaacaacggcattaccctgcagatggccagggtctcccagcaaggcatgaagctgctgcaggagaatgagcagctcaagggaagacagaacaatctgtgcaaacagctggagctgctggagaacacccagaaggtcatggccaggcacaaaagaggccaccagaagatcatcctcatgctgactaagaagtgccaggagcagcagcaggacaccaaggaggccgaggagctgcgcctcctgctgagccagttggagcagagatccctgcagctgcaggtggataaccaggcactgaagagccagagagaccagctgagcctgcagctggagcagcagcaggtggatttgcagcggctacagcaggaactggctaatgagcagaaggttcgggccagcctggaggcggctctggtccaggccacctccttcctacagaacattctgcagacagggaaaacttcgtggaaatgggcactgaggttggaatttcctggacgagggtgggtactggggccactgtgggcctgctgccaccccaccctcaccaacagatgcaccgcgatgaagaggacagtgacgttgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatatatcacccgtgtggggaccttccgggcacacagcagccctgagatgcgtgcccctggttctctaaaaaggcttgaaaagtttagtcttcctgaagttcccctacgtcccaagtaggacacagagagaagaacctactccagaaatggactggtccagtcacagtcacccccactttaatccgcaggcagcctggaacagtctagaggagatttgtataaaaagtagatacc

SEQ ID NO: 119654 - DNA, 409 bp, Homo sapiens
  Payload ID: 3465
  Gene Symbol: CFAP157
  Gene Name: cilia and flagella associated protein 157
  ENST ID: ENST00000461104
  CDS Start-End: 1-409
tgacgtgacgttccagccatggcacaaggagatgctgcagcaactgctggtcatgctcagctccactgtggccacgagacctcagaaggctgcgtgtccccaccaggagtcacagtcccatggcccacccaaggagagccggcccagcatccagctgcccaggactgggtctctgctgccgcagctctctgacatcaccccctaccagccgggggatctaggcctggtacctcgccaggtccacatcccacccaacccccaggacctcaggctgctgtcatatatcacccgtgtggggaccttccgggcacacagcagccctgagcgtcccgtgggccccaacgcagaggagcggaaacgcagagcaacgctgcagtggggaaggggcgcgaagaaggggcccagaaac

SEQ ID NO: 119655 - DNA, 1631 bp, Homo sapiens
  Payload ID: 3466
  Gene Symbol: CFAP161
  Gene Name: cilia and flagella associated protein 161
  Uniprot ID: Q6P656
  ENST ID: ENST00000286732
  CDS Start-End: 84-989
gcctggggccgggtcgtcatggcgacgcgccacgctaacgcatggtgtcggagggaggcccacttgctgaacagcagggagcgatggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccggcaaatgctaaaattctcatcaatcactgtcacacaaatcggggactggcagcccaccggcatcttttcttaagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcagtaacacgccaggcacgtgcatgttttccctggtcccgctctcatcaaatgtagctttaaaagaaattaacaaccttggtcatgcctcaagctatttttgaatcagatgtgggactctctgggcactatattaaaataaagattacattaagattattgaatttgtggtgggagtctagggctgaagaaaaacagctctggagaataattagtatttgaaagtgacaaacaatagccttttgttgataaacaaattctgaagaactcagcttcctctacttatatccttcattgtctacaaggacagtgcgttactttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttcca

SEQ ID NO: 119656 - DNA, 574 bp, Homo sapiens
  Payload ID: 3466
  Gene Symbol: CFAP161
  Gene Name: cilia and flagella associated protein 161
  ENST ID: ENST00000560091
  CDS Start-End: 241-574
gcattttcacctgggactgttccctgggctgccttgtggtttgcatcaactggaagaggctttaaggagaccatctctgagtttccagtgtgggcacaggtgggcttatctaaatcagatcccaaatagtatttaaaaagcctctaccaaaagaagaggaggggctcaacctgagagaaaactcaccagggcagaaaagatgacagccatggaagcagagctcaaaggactgaagagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgcca

SEQ ID NO: 119657 - DNA, 572 bp, Homo sapiens
  Payload ID: 3466
  Gene Symbol: CFAP161
  Gene Name: cilia and flagella associated protein 161
  ENST ID: ENST00000561216
  CDS Start-End: 256-572
attcatgtgtcaatgaagaattcctgccagacttccagtactgtcctcgaccatgggcagaatcccagctgcccctcccagaacactccatgccactggaactcaggagcgcaggtgggcttatctaaatcagatcccaaatagtatttaaaaagcctctaccaaaagaagaggaggggctcaacctgagagaaaactcaccagggcagaaaagatgacagccatggaagcagagctcaaaggactgaagagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgag

SEQ ID NO: 119658 - DNA, 1354 bp, Homo sapiens
  Payload ID: 3467
  Gene Symbol: CFAP20
  Gene Name: cilia and flagella associated protein 20
  Uniprot ID: Q9Y6A4
  ENST ID: ENST00000262498
  CDS Start-End: 336-917
gcgctcccggggggcgggctcagatgggcggagggattcattttaagcaacgggcggccctccgcctccattgaaggcggggaaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaatttg

SEQ ID NO: 119659 - DNA, 572 bp, Homo sapiens
  Payload ID: 3467
  Gene Symbol: CFAP20
  Gene Name: cilia and flagella associated protein 20
  ENST ID: ENST00000565880
  CDS Start-End: 247-572
gcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcagatgacaagaatgtgcgtcgtcgctttcgggcaagtaactaccagagcacc

SEQ ID NO: 119660 - DNA, 2196 bp, Homo sapiens
  Payload ID: 3468
  Gene Symbol: CFAP206
  Gene Name: cilia and flagella associated protein 206
  Uniprot ID: Q8IYR0
  ENST ID: ENST00000369562
  CDS Start-End: 113-1981
atggttacgcggcggtggctgcgagcgcccaactgctccgaccgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaaggtatattaacatctatacaaattaattttgtaggggtggcacattcattggttgtgtgactgtttattgggttcccatattttatcaaactgttttctgtaacacatttttcattctgttgaaattgaaaaataaaactgtccatttatctttta

SEQ ID NO: 119661 - DNA, 1050 bp, Homo sapiens
  Payload ID: 3468
  Gene Symbol: CFAP206
  Gene Name: cilia and flagella associated protein 206
  ENST ID: ENST00000480123
  CDS Start-End: 296-1050
ggagcgcgcacacagatccggagcgcgcacacagatccggagcgcgcacacagatccggagcgcgcacacagatccggagcgcgcacacagatccggagcgcgcacacagatccggagcgcgacggactctcccactgactggcacttgcgcatgcgctgcctgtgatcttggagtactgattataagctgttttaagcgattcccttaagccgcgcactgttgtaaccactaaaaacaggactaatttagtcctcacacctctggaaagaagtgaagcaagtgcccaagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccact

SEQ ID NO: 119662 - DNA, 2267 bp, Homo sapiens
  Payload ID: 3468
  Gene Symbol: CFAP206
  Gene Name: cilia and flagella associated protein 206
  ENST ID: ENST00000489338
  CDS Start-End: 66-353
gtcgcggtgagggccccaggacagaagcagacagacacggctcctgctgtcgattccgatccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagcttaagaaattacttgttttcctgaagtagaattgccatatccaatccagtttttctctagttcttacgtaagaagaattctaaaaattaaatatatagaacattgttatttggcaattttagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcagatgagagatgctgacaaacattatataaaaccaattacaaaatgtgaaagtagcacacagacgaatacacacatactgccaccaacgattgtgagatcatatgagtggaatgaatgggaattaagaagaaaagctataaaattggctaatttgcgccagaaagttactcactcagtacaaactgatcttagtcacttgagaagagaaaattgttcccaagtgtaccctccaaaggacactagcacccagtccatgagggaagacagcactggggtgcccaggcctcagatttacttggctggtcttcgtggaggaaagagcgaaatcaccgatgaggtcaaggtgaacttaactagagatgtggatgaaacctaattacagacaacgttttaaaatagatgctactcaattatgaacaatagcaagtacttaaaggtatattaacatctatacaaattaattttgtaggggtggcacattcattggttgtgtgactgtttattgggttcccatattttatcaaactgttttctgtaacacatttttcattctgttgaaattgaaaaataaaactgtccatttatc

SEQ ID NO: 119663 - DNA, 2985 bp, Homo sapiens
  Payload ID: 3469
  Gene Symbol: CFAP221
  Gene Name: cilia and flagella associated protein 221
  ENST ID: ENST00000295220
  CDS Start-End: 127-936
gtccgcgtcgtcatggcgacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttacccagcctaagtcaactgtaggatattagtgtggcctgctgaacccaaatcctgcaaataaccatcattgaaatcactcgggcaacaaacaagtagaactgaacacaaattttaaaactgctgatttttctggtggcaaataagcagattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatga

SEQ ID NO: 119664 - DNA, 2167 bp, Homo sapiens
  Payload ID: 3469
  Gene Symbol: CFAP221
  Gene Name: cilia and flagella associated protein 221
  ENST ID: ENST00000413057
  CDS Start-End: 110-271
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaacatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttgtaagtgacaactggcagaagccttgttttctgtgttcctttatttcagcaattactctataggaaacagagcactcattgggaatattttttctctttggaatttcaagtgttaaacaatatctgacctttaatattgtttgccaacctttattttttggagaatatcagtgattccgtctttt

SEQ ID NO: 119665 - DNA, 2801 bp, Homo sapiens
  Payload ID: 3469
  Gene Symbol: CFAP221
  Gene Name: cilia and flagella associated protein 221
  Uniprot ID: Q4G0U5
  ENST ID: ENST00000413369
  CDS Start-End: 88-2610
gctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatga

SEQ ID NO: 119666 - DNA, 450 bp, Homo sapiens
  Payload ID: 3469
  Gene Symbol: CFAP221
  Gene Name: cilia and flagella associated protein 221
  ENST ID: ENST00000434869
  CDS Start-End: 1-290
agtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacggagcacctggatctgctgctgtatctgtgacgacagagtcggggtatagcacaaagaaggccaccagccctgcatgacaagagctccggcacattaggaagactcttggtcccagagttcctccctacccgctatttcctgaactcctgttactgaagacccattcctttagctttgcgctttgtttctattaaactacctctggggag

SEQ ID NO: 119667 - DNA, 779 bp, Homo sapiens
  Payload ID: 3469
  Gene Symbol: CFAP221
  Gene Name: cilia and flagella associated protein 221
  ENST ID: ENST00000442513
  CDS Start-End: 253-779
ggcgctggcgccggccgaatccggcccgggaaccacctccaggattcactgcctgtcgcttgatgttgtccgtcttgggagtctgaagctatgggtcttctccagaaaaaacaaaaccgaaaaaacacacaaagatccacactaattaacattccatttcagaggcttcgccgaccagccccatggcctgcgcaagggccccaaggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaag

SEQ ID NO: 119668 - DNA, 3294 bp, Homo sapiens
  Payload ID: 3469
  Gene Symbol: CFAP221
  Gene Name: cilia and flagella associated protein 221
  ENST ID: ENST00000443972
  CDS Start-End: 1-1199
ttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggttgaaaaggtcgtggccccttggaaagattgtattgactgtgttggggatctggtgccacctggtggttgccacaagaaaggcctctcctgactcccaagttgtaacccgtttccaccaaatcgacttccaaataatatttatcagatcatcatctgtgcttttcttccttgtttcagaccacttttaggtggaaaaggcaaagaaggcttatatgtattttcttccataatgagtccatcagaaaaagttccttcggtgaaatcgttgaccacgtgatgtttggggactccctatgggatcaatcatccgggttccttagagaccatggccataatcaggggctggccaagggaatgagtatccctgggttcaacagctgtttctgaagacctgccagttcccctgtcttgcattaactcgggttatcatgccattctccttctaaggccaaagatacctgtaaccgaagaatcgggatacttcactgcagtcacttcatttttttttcttttgaggcagagtcttgctctgtcacctaggctggagtgcagtggcacaatctcggctcactgcaacctctgcctcccaggttccagcgattctcctgcctcagcctctcaagtagctgggattacagggacccgccaccacgcccggctaatttttctatttttagtacagatggggtttcaccatattggccaggcttgtctcaaactcctgacttcaagtgatccacccgcctcagcctctcaaagtgctgggattacaggcatgagccaccatgcctggccaagcagcttcattttagaagtgattattattgctttcctttctagaacttccggtttgtgaagtattttctcaatgatcctcaaaacattctaagacataaagtagctgttattagtgtgattttatgcagaaactcaggcccagaaagcttcatggacttacccaattagcagaagagccaggtttgggcaggatcttggtttcctgcaaaggtttcgttgcctagccaggcgtggtggtgtgtacctgtagtcccagctacctggggggctggggtgggaggctcacctgagcccaggtagtcaaggctgcagtgagccatgatcctggtacccagtccactcttctctctactacatggtaatcaatgaaaatattacagatttacattttttaactttttatttaaactttcagctttggagtctctaagagtaaagatattatgtgatgatatttgtattttacttaattgcttattctttaaaacatgtaatatagaaaaaaatacaaattagcaaatgtcctttgctctaaagaaatcagctggcaagtttgccccacccagcagcagccatgtcttactcatttctgtatccccagcatgcagcaagatgtttggcacaatgcaggctctcaataaatgttttttgaggctgggtatggtggctcacacctgtagtccctgcactttgggaggctgaggcaggtagatcccttgagcccaggagttcaagaccaccctgggcaacatggtgaaaacctgcctctacaaaaaacacaaaaattggccgggcatggtggcccatgcccagctacttgggaggctgaggtggaaggatcacttgagcctgagaggtcaaggctgcagtaagccgacattatgccaccacactccagcctgggcaacagagcaagaccctgtctcaattttttaaaaattggctaggtgcagtggctcatgtctgtaatcccagcaccttaggagaccgaggtggacggattgcttgagctcaggcattcaagaccagcctgggcaacatggcaaaaccccatctctacaaaaaatacaaaaaagattagccaggtgtgttggtgcacatctgtggtcccagctactggggagggtaagatggaaggatcacttgaccccaggaggctgaggctgcagtgagccaagattgtgccactgcactccagcctgggcaacagagcaagaccctgtctcaaaacaatagcaataatgtttgttgaattaaggaatataaaagaaatgtgaaaact

SEQ ID NO: 119669 - DNA, 1267 bp, Homo sapiens
  Payload ID: 3469
  Gene Symbol: CFAP221
  Gene Name: cilia and flagella associated protein 221
  ENST ID: ENST00000594371
  CDS Start-End: 1-521
taaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagaattaggaaacatctcacagagtgaagattgactgcatacctctaacagagcctgatttaagacaggatttgtgagtttggtagacaatcctatgaagttttcattttactgttgactgaagaccatacactgtacggtgacccttattcagaatttttatcagaaacctagggcccctgaacatgagtatataaagtctgatgcaggcctataccctattggggatctcatgtgctcacagtacagctacgctcctctcaaagagacatcatagctaaggaacaatgttttaaaaacaagtaccagtgcaaattaattagaaacagggcactgcctgacgttaggaactctgcattcagagtgtagatctctcaaaagtacagttagagacatctggtcaggatgaagcagtgtgcgcaaactgcaatgaaccttttttgtgcaaaattactagttagtgacaaacaaaatataaagagacctccaaaaagacacactcaggctcagaaacaagctgaacaactccacagagcaggaacagcatagaaatgctgagtgggttgcagggtggagccacaggcttgcaggctccaggttttgaagcagtcaggcagtgttggagaccactccatggggtaaaggagactgcaagtgtctcactgattcaggggatccgcacttggcctgcagccaggagaagaggtaagctgccccacctttgcacttcccacgaaaggaagctggaaaccctctgctgacctgttgcctgg

SEQ ID NO: 119670 - DNA, 689 bp, Homo sapiens
  Payload ID: 3469
  Gene Symbol: CFAP221
  Gene Name: cilia and flagella associated protein 221
  ENST ID: ENST00000463985
  CDS Start-End: 110-514
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgttcactgaaaaagctcattggcacgatgtcccctggaattgtcttagacattatttggttgaaatatccctgcccgcaccatcactatgtctgctgactgccttctctgccatccaccacgtggatcacagctcactgctgcctcaaactcctgggctcaagtgatcctcccacctccgcctcccaagtagctgggactacagcatctggtcaatgtttccaatgaagacacacgtgttcatattttacccccgcaaaccaaatactttgagatcaattatgtaagaaaggaacaccacctggtccctggcttgtccctcacggtcaccgttacattttc

SEQ ID NO: 119671 - DNA, 964 bp, Homo sapiens
  Payload ID: 3469
  Gene Symbol: CFAP221
  Gene Name: cilia and flagella associated protein 221
  ENST ID: ENST00000594033
  CDS Start-End: 88-360
gctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctggtgctggctggatctccagtcttgggagtttaggttcctgtcttccttgggaccattcaggaatactggaaaaatggagcgaacccagcagctttgaggacagatctctgttctggtcttctgcccataatgtcgcttgttggaaactgatttaagccagtgagcttatttctaattgtcaggcagatattgagagtctgaccctgacagcatgtgggagtcataggtccactcctcagcagccttgctacaggtggtcggctgcagcgaacaggtctgagaagacactctgcaacacatatgaacacttactagcaagcaggcaaaaagatcattgtgtttgtaatctcacgaagtcccagctgcagttcctagtggggaggctttgatggccgcagcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcact

SEQ ID NO: 119672 - DNA, 401 bp, Homo sapiens
  Payload ID: 3469
  Gene Symbol: CFAP221
  Gene Name: cilia and flagella associated protein 221
  ENST ID: ENST00000599827
  CDS Start-End: 1-355
aggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaaggtgaagtatggctgcaaagcacagagatgccgagactgatcatgcctctgagcgtgaactttccttagaatgaagttagctctatgcaaataaaaaattttcaccagtcacaaa

SEQ ID NO: 119673 - DNA, 440 bp, Homo sapiens
  Payload ID: 3469
  Gene Symbol: CFAP221
  Gene Name: cilia and flagella associated protein 221
  ENST ID: ENST00000600951
  CDS Start-End: 1-266
tcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttacaagctgacatggagtcacagagtgttagtgctagtgggagccacagacagcattagctgatgcctgtcctatgcctggcttagaaactggacattattcccggaataatgcactggaaaagcttccagtccctggttctctcctccctgccggacccctccaagatggagaccacaaagag

SEQ ID NO: 119674 - DNA, 743 bp, Homo sapiens
  Payload ID: 3469
  Gene Symbol: CFAP221
  Gene Name: cilia and flagella associated protein 221
  ENST ID: ENST00000594141
  CDS Start-End: 1-141
gttattcctttgcagtgcagctgccctgtagattttgagttttatatcaccttgattcagtctcatcaagcctttgctattgagccaacatcaggaactagaagcatcatctacgcacaccttccaggcattttatgctgaagtttgccaaatgaaaaaacaatttgaatcaagctattaataattctatttataaggtatgccctcaactttaactcaactggccatccttaagatgcaggtgggctctgtagccgtcaaaagctggacctgctgttgttgggggccaagatattcctgaggctggagaaaatgaataaaggattttatgaccttcctgtactgctgacaagaaatcatatgcaaccaaaacttcaagaacactctgttgataattttggaagagccagcaatgcacgactttggccaagatatttttttttccgtgaaatctgaagagaagtattgaccaagatcttattagcatcggagatcaggcaaatgccacaaaaaaattgttgaacttgtctacttgtcactattttgtgatcctggacattcccttgttgtcacaaatgctagggaagaatgcatctaactcatataaatggtaaattatagcattaagtggctggctaagcaagagttccttgggggctgttgcttagagttcttatataaagtttcaataagttcattctctttttttaattataagaaaaatataagccacttacaaataa

SEQ ID NO: 119675 - DNA, 1532 bp, Homo sapiens
  Payload ID: 3469
  Gene Symbol: CFAP221
  Gene Name: cilia and flagella associated protein 221
  Uniprot ID: Q4G0U5
  ENST ID: ENST00000598644
  CDS Start-End: 74-637
aatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagtttacccaacagcgtcttcctggtaccagataactagttgaaacttggagcaggtccagttggttgaccagttgctctcccatcaactcattttccttgcaccaagatgactttaaccaattggttagcgtgctctagacaaacctgcctgaaactcacctggggaagtgatgacaaatccaggagaggatccactgtggatctggtggctgaagatctggtaaaatgatgccatgggcaaggccgccatgggctcctgcagcaagtggaccatgtactcatctcaaggctatagaggctctgtagcctgcagggccacattaacaacattcacagaagaggctcctggtgactccattccaaagccaggatactttagcttcttgaacttttatgtcataaggtcagaaatttaccaaaggatgcttttccttacttagtgaatcttatggctccttttagaaagcgtgggaacaaccaaggtcagaatatgatgtttgagtgtaaccaaattctcctactgcccctggagcttaaagcatctgggccacatgggaatgtgcactcttaagctagtgctaagaaggaagattgatggtgagagtttgcccccacgtagacagcccccagtcttgcattgtgccaataaacagtctctaggagagggggctgagaaccagctgtaactgggttaaaatgcagatgtcaggagaagacgatcaaattgatgttcacaagtgttttttgaagccctccctactcggagagaaaaaattcacttttttcagcttgtcaagggaaacactgcttactcatatgagggactcattttatgtgccccaagcttgaagttgatggaaaggagcagcagcattttatgaaagcatctgaccagggtgacgtgagctcacgacatagtcgttctttacttt

SEQ ID NO: 119676 - DNA, 2048 bp, Homo sapiens
  Payload ID: 3470
  Gene Symbol: CFAP36
  Gene Name: cilia and flagella associated protein 36
  Uniprot ID: Q96G28
  ENST ID: ENST00000349456
  CDS Start-End: 149-1177
ttaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaagacctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactgagccttttagtttcgaacacttttgtaaatccaaatatcttaaacactttaggtaaaggacagtagggaaggcagctactcatactgattagtttaatacaaattcctggatgttttcccttggaaagagggtatagaaggaaactagttgatagtatgttcattcattcaaactcggttacctactgtttgtgccaggcattgtgctaagcactaaggatacaggagtcaactagattgacagggtcactgccttcatggggctagtggagagggcccaaagacgaaactgttagaaaggcaaagtgtagtgtcctatgagcagggctggctaagcctctttaagctgaatggaaggttaattacacaaagaataggtaaggaacagttcaggttctgcagcaggaaataaagcatatactgaaaaactggagtatatatatgagtggagacggttagcatatgaaattggagacaggtgggggactgacagtgcagagtcttacagggaatgtgaggatttaatttttttaaaaattattttagagacaggatcttgctctgctgcccaggctggcgtgcagttgcacaatcccagctctggattttaaattttgtaataccagcagtgtcaagtcattgaaaaattttaatgcaggggccaggcacggtggctgacactgtaatcccagcactttgggaggccgaggtggacagattgcttgagcccaggagtttgagatcagcctgggcaacatggcaaaaccctgtatctactaaaaatacaaaaaattagctagg

SEQ ID NO: 119677 - DNA, 1373 bp, Homo sapiens
  Payload ID: 3470
  Gene Symbol: CFAP36
  Gene Name: cilia and flagella associated protein 36
  Uniprot ID: Q96G28
  ENST ID: ENST00000339012
  CDS Start-End: 199-1302
gggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagttaactgcaaaggagggcatgtgataactccaggaagcccagagccggtgattttggtggcctgtgttccccttgtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaagacctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactga

SEQ ID NO: 119678 - DNA, 1125 bp, Homo sapiens
  Payload ID: 3470
  Gene Symbol: CFAP36
  Gene Name: cilia and flagella associated protein 36
  ENST ID: ENST00000407816
  CDS Start-End: 113-1054
gactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagacctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactga

SEQ ID NO: 119679 - DNA, 1575 bp, Homo sapiens
  Payload ID: 3470
  Gene Symbol: CFAP36
  Gene Name: cilia and flagella associated protein 36
  ENST ID: ENST00000406691
  CDS Start-End: 157-813
attttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaaattcaaggaagctgagcgacttgtccaagatcaccgaactcttcaatggtgaaattatgacttaccttggtcttctgacactaaatatattcttctaaaccttagtttagaagaacttctataattgagattagtgtgatgtttacccattaattttttaatgtaagttggagaacacctttctttaatatgcctaatttaagctgttttaggttcacagtaaaattgagcagaaggtacagagatttcccccatatagtccctgccctagtacatgcctagcctctcccattatcgaccccctcaaaagtagtacatttgttacgttggtgaaccttccttgacacaacattaccaaccaaagagcatagtttacattagggttcactcttgctattgtatattctgtggattttgacaaatgtatgatgacatgcattcaccattatagtatcatgtagtatacagtttcattgccctaaaaattctttgtgctctgcctattcatccttcccacctcctagcccatggcaaccactgatcttttactgtttccacagttttgccttttctagaatgtcatatagttgaaatcatacagtagtacgtagccttttcagattggcttctttcacttagtaataatccatttaagatttctccatgtcttgtcatggctttgtagctcatttctttttagtgctgaataatattccattgtctggatgtgccacggtttgtttattcatttatctgctgaagaaaatcttggttgct

SEQ ID NO: 119680 - DNA, 759 bp, Homo sapiens
  Payload ID: 3470
  Gene Symbol: CFAP36
  Gene Name: cilia and flagella associated protein 36
  ENST ID: ENST00000403007
  CDS Start-End: 72-743
gtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacaggtgcctacagaacatataacagaagtattttattgctgttatctcttattaagtttacacctagatcttactattaaaatttatacttatgtggaactacataattttaagtacaatgtaaatattgaccaataatattaatatatcaata

SEQ ID NO: 119681 - DNA, 2963 bp, Homo sapiens
  Payload ID: 3471
  Gene Symbol: CFAP43
  Gene Name: cilia and flagella associated protein 43
  ENST ID: ENST00000278064
  CDS Start-End: 327-2939
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaagtactattttaaatatacatgtgtttatataagtga

SEQ ID NO: 119682 - DNA, 5365 bp, Homo sapiens
  Payload ID: 3471
  Gene Symbol: CFAP43
  Gene Name: cilia and flagella associated protein 43
  Uniprot ID: Q8NDM7
  ENST ID: ENST00000357060
  CDS Start-End: 117-5114
acgggtgtacacagcagcggcgtcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtttatgatcagcaaggaatatttctgttagttggaacagcagaaggaaaagtctttattatcaatgccaactcctcaagctcatttcagattattggattcacagaggtggccaaagacattttacagatatccacagtgtctcttttagaaacagacatagtggaagtgatggtgctttcctcgcttccagaagcagggagaagcaggttggagatgttcacactgcctacattactgccacaagtttccacaacctttgctgatgaaagaggaaggctgaaagatgaaatcattcataagtacctgtatgagttggagcacgctctgtcctctgcagtcttgggctttcaaagtaaccaaatatatggcttctgtagtcaagtgccatacatctgtagctaccttcttcctgaagaagaacataccggtatctacattcttaaaccatacaaaaaagtacaaagcagacagtatggacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagta

SEQ ID NO: 119683 - DNA, 1434 bp, Homo sapiens
  Payload ID: 3471
  Gene Symbol: CFAP43
  Gene Name: cilia and flagella associated protein 43
  ENST ID: ENST00000369719
  CDS Start-End: 305-1216
tcgcggcccgcagccccgcggcggcggaaaggtaaccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaaggtatgttggatggtaatttcttgatatgtgattttcagatagtattattatcatcattacatgacaggaatgaggagcagagtatgctgcacagtggtactctacttgtcaagactctaggttgtaaatgaaaaaatacccaatttaaaaggcctaaattacaaagagctattggtttatttttgtgcatgtaactgaaagggcaaggagtgaatctgaataaaagagctaccatgatgcca

SEQ ID NO: 119684 - DNA, 2876 bp, Homo sapiens
  Payload ID: 3471
  Gene Symbol: CFAP43
  Gene Name: cilia and flagella associated protein 43
  ENST ID: ENST00000369720
  CDS Start-End: 270-1508
ccgacccgccctggggtgctgcgtgcgctgcctgctcccgcctgaggaaaacactgcccatggcgcaaggccgggagcgcgacgaaggcccccactccgccggcggcgcgtccttgtccgtgagatgggtgcaaggattccctaagcagaatgttcattttgtcaacgacaacaccatttgctacccttgtgggaattatgtaatatttattaatattgaaaccaagaaaaagactgtactgcagtgtagtaatggaattgtgggcgtcatggcaactaacatcccctgtgaagttgtggctttttctgaccggaagctaaaacctctcatctacgtatacagctttccaggattgaccagaaggaccaaattgaaaggcaacattctcctggactacactttactttcattcagttactgtggcacctacctggctagttactcctctctcccagaatttgaactggccctttggaactgggaatcgagtatcattttgtgtaagaaatcacagcctggaatggatgtgaaccaaatgtcttttaaccccatgaactggcgccagctgtgcttatcaagtccaagtacagtgagcgtgtggaccattgaaagaagtaaccaggagcattgtttcagagcaaggtcggtgaaattacctctagaagatgggtcattttttaatgaaacggatgtcgttttcccccagtcgttgccgaaagatctcatctatggtcccgtgctgccactgtcagccattgccgggctggtaggcaaagaggcagagactttccggccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattggaagacagaagaaattttatcagtccagtaaccttggtatatcagaaggagggcgtgctggcttctggaattgatggctttgtgtattcttttattattaaagatagaagttacatgatcgaggattttcttgagattgaaagacctgtagaacatatgacattttctcccaattatacagtgttgctgattcaaacagacaagggatctgtttatatctacacttttggtaaggagccaaccttaaataaagtcctagatgcttgtgatgggaaatttcaggcaattgactttatcacacctggaacccaatacttcatgacacttacatattcaggggaaatttgtgtttggtggctggaggattgtgcttgtgtaagcaagatttatctgaataccctagcaacggttctggcttgctgtccatcctccctctctgcagccgtgggcacggaggatggctcggtctacttcatcagcgtatatgataaggaatcccctcaggtcgtgcacaaggcctttctctcggaatcgtccgtgcagcacgtcgtgtaagtcctttctgcctccaggagcggctccgtgtcacacccgtctgttgaaaattctagtgaagccatcctttcttttaattttaagttttacgtgtttcatttgttttgaatgttaatatattcacacagttcaacactcaaaaggtacagagggctgtgtagtaaagtaccccccatacccaggtctgtccttgcaggcagcctggtaccaatttctcatgtctctcctgagatgttttatccatgaacaagcaaaacataataagcacttctttttacttgtatcaatggccatcatgtgtgtatagtgtgccaggcacttctgctgtattaactccatgaggtaaacactcttgttgtctctatttgacaggtgaggaagataaggcacaaggattttaaataacttgctcaatagtacacagatagtgaatggcaaatgttgggatttgaacccaggtagttgggctgcagagtcactgcctttgctcttaaaaggagaaaactatgtacaatgcctcatttcttttttcacttaatcgtatatcttggagaatgttttatatccacacataaagaccagcctgattatttgtatagccacatagtattccattatatgaatatactatcattttttaaaaacggtatattaatgaacatttagagtatttcaaaacttttgaagcaatacttttaagatgataatatagagacattagatttggacttgtaggtgctatcattattactgtttctttttaatttattatattattaggtattaataagaacagacatttgtattctgctttacagcttgagatcactgtagcttgtggcatgtgatcctcaaaacaccagtcagaaaggtgttattcttatccctattagacaaattagggaattcagggttagagaggtgaggaaaagcattgtccaagattacacattacacagctagcacactgaggagctggccctgccactgtggactgcccagctccaccaccctagctcagtggggaaggatggataacctccttccatttaccccctgcctttctgcactgtcatttttttgtgcctttcctttctcagatcctcttattctaatttacatcttcccactttttctaatttgataaagttgtagacatgtttcactacattcttcctcccactgccaggtaccagacacagggtaatgaaatgtcacacccaccactaatttgagaattgcttatttgcgcttgaaacatcaagaaagctctaccgacagacatgtttcattcacttatgatgaaccaactgcccatctttactgaatcttcttgactgtatttattaaagttgcaatttggaaata

SEQ ID NO: 119685 - DNA, 3198 bp, Homo sapiens
  Payload ID: 3471
  Gene Symbol: CFAP43
  Gene Name: cilia and flagella associated protein 43
  ENST ID: ENST00000434629
  CDS Start-End: 1-2993
gacctggactgctctatctgtcttcacatggattgtggctcataacaatagctaaatgtggaattctgtgtatccgagacgtttatactttggaaacatttgcttggtgtcggagtcattctcaccagggtcatgggattcagtcaatgagaatttcaatggatggacaaaacattctggtgaatgggagagatgatggcacccttgtctacctaaagtggaagcgatttggaggacacctagccagtgaaattctggactattaccagaaactattaatttccctgagcagcgccatggacaaggagaatcattatttaagcacaacaccaaaagtttccgtagatttgggatccgattctgaacacacaaaacagaaggcaagcactgacttatcacaagatgaattagttctaaccgatgttaagaaggaaattccttggatacaacaaaaaagccaagaggccatcaaaaaggaggttaatctgttttccaagaaaaggaaagagataaaacaaggaatcaaatcactttccaaaactattctgaatatgatggaagaaaatgacaaactagaaaatattgcaaaattagaccaacaggaatttggtctggatcttgaggaactagaaaggcttcatgatgaaagtcaggaagaagtggcaaagatgataaaggatgtagagatgcataacttagccaagagctatttggctgaacttatcaaagaagaatgttggaattcgatggctgtgaaaggtcgagctcttaagtgttttcatatcccctgtgtggttgaaaacttcccgatgaaagcgcgcacggttgaagagctgaaagaattggaaagagttttacagcaaaagaagattgaagcagagtgtcttaaactacggaaggaaattgtagaggctcagtctggagttaagttgattaaacagcgtcatgaagaggatgatgaagaagaggaagaggaagacaagacagtaaaatatagcaatttgcccaattacctgcttggtagtctgagtactgattttggggtagatacctctttattgtcaagccaattggagcttcattccagagaagagaaaatcaaccaaattatattattgaaagatatcatttacaaggtaaaaactgttttcaataatgagtttgacgctgcatataaacaaaaagagtttgaaattgcacgcgtgaaggaaagaaatgttcgaattcgagaaattattttagatctggaattggaagaagcagtctggcaaccagaatttgaagactgtgagaagccagagagaacgcttgttgtgcaagatgaggagattacagcccacaaacacattaagccgtggcacaaagccaaagaattgatcgtgaatcatgaaaaggagcactggcttctgatacaggatgccagtacaagactccgagctctgatggacatgatgggaggagttctggaagtcaagaaggaagatattttgagaatggtgattcctcaacctgctttcatggcaaaacctgatgctgtgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaa

SEQ ID NO: 119686 - DNA, 1794 bp, Homo sapiens
  Payload ID: 3471
  Gene Symbol: CFAP43
  Gene Name: cilia and flagella associated protein 43
  ENST ID: ENST00000457071
  CDS Start-End: 1-1544
tgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagt

SEQ ID NO: 119687 - DNA, 3377 bp, Homo sapiens
  Payload ID: 3472
  Gene Symbol: CFAP44
  Gene Name: cilia and flagella associated protein 44
  Uniprot ID: Q96MT7
  ENST ID: ENST00000295868
  CDS Start-End: 164-3112
gggttcccggagagctggacgccggccgcgcatgcgccccacggcccgccctggttccgcctccctggaagaggggtggcgttgtctcggtaaccggagtaaacggaggcctccggcagacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtacattcttttggttatgactgtagaaagcgagccaacctacaacttctggacgacagtatcgccatatacatagctgggaaccaactgatctttctgaatttgaaaaccaaggaacagatctacctgcgaagtagcagtggtgaaggaattggcgtcattggggttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaacattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagtaagcctaatataaacttgatttttattttaacatatgctatttctggatagagatgactattttcccaacaagtagaaacacttaaaatcatctttcttttttgtttgtttctttcaaaatttcaatagccatttattttgggcatcttttaatttgtatgtggggtttatcccttttaatcagttaagattcttgttgacacaaattgttttacatcaactgttgttatagaacacatgaaaggaatacatggggaagaaataaagtagaacccaag

SEQ ID NO: 119688 - DNA, 10259 bp, Homo sapiens
  Payload ID: 3472
  Gene Symbol: CFAP44
  Gene Name: cilia and flagella associated protein 44
  Uniprot ID: Q96MT7
  ENST ID: ENST00000393845
  CDS Start-End: 68-5632
gagtaaacggaggcctccggcagacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtacattcttttggttatgactgtagaaagcgagccaacctacaacttctggacgacagtatcgccatatacatagctgggaaccaactgatctttctgaatttgaaaaccaaggaacagatctacctgcgaagtagcagtggtgaaggaattggcgtcattggggttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgggtggctatgattctggttttctatatcactgtgagttccccccttgtgatgaaagcagtgatttcaaagaacaaaaagatgaacctattgatgtccgttatcttgcggatacagaggacaatcccatccaaactatcactttcaacattaacaaagttatgatgttttgtggaatgaaaaatggagcaattcgagtctatgtcctaaatcaaaatgatccttcattgaccagtttggtggactactggcacttcaatatgcatgacaataattatggatgtattaaaagtattgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacaggatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgtcccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcagcatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtcatagccctgagtgtcttatttattgcggtaaaaaattacccccaaacttagcttgaaacaacaaacttgtgatctcacccaggagtgagagggtttctgaggtccaggaatctggggacagcttggccgggtgttctggctcagggtctttcgtggagttgcagtcacactaggagctggggctgcagccatctgaagcttggctggagctggaggggctattagcaaattcactcccttggccattaggcagggcttcagttcctcgccatgtgggcctctccatagggccgcttgggatatgacttctcccagagcaagtgatccaagagtgagggagacagcaagagagaatgatgtatacaagagccacagtcttttacagcccaagctcagaagtgacatagcgtcactattgtcatatgggtcacaggctgaccctgtgtgatgtgggaggggactgaacagggtgtgaatgccaggtgggggtcaccggggccttcgtgggagctggcagccacaagaagcagctgcctggagagagtggctggtctctgagaaaggtcttgaggcgataccatccccttggtaattgtagagaatcaggagaagttacgttatcttcctgggcctcattttattatctgacaaatgaaggattggtagaatgggttccttcccattctgagattctgattctgattgcagcaagaatggacctacagtctacagaagagccacatcaggacttgctgtgcatttcaactgagaggaaagctaatcgggataattattcccaaactgagctggactaaatcactagttaattctacaatattcagggcttcattccgcatgtttgggaattgacgacagttaacactgaattactttattttgaattggacaaaatatgttgatagctttaggttcatttcaacttgattccaggcttagtcttaaatctgtagttaagttagagcatctgagtctttgggaagttaagcttcaaacacaagtagaccagcagggtgtggcatgggcagggtggctgggaagctatcctgctcctggcacacttccctgccttctgctgtgctcccagaggagcagcctcacctctgagggtaaggccaaaaatcagcctacactgagttacttgtgggtcaattgttcatataacttggctcttctgaactgtcatccatagtatcaccgatgatcaatctcagcattggaagaaaaagaaaccacagagtccagcccctctgtcacaacttcagagtaaaggagttgctcatgcctgccagccagcctgtcccaccacagcgggctccccagcttagggaggtctgtgagccatgtgctaaatttctctttagagctaaatccattgagtgctatgattccagtgctgtgcagaaagcagatgtttcacctatcacttcagaaaagttcaccagacttcattttgacagctaccttagatcatcaaggagaaaaaggaaaaaatgtaaaaaccagtggggctagaaggtgagttacagctcagattggggggcctctggatagcaaagcaatgactgagagcgtcagccctacccaccccagaagtgagctctgggccgtgatgccaggttgtctgaaatcacagtatcttattttttctcttctcttccctgctctgcttctcatttcctaacatttacctgttccttacagtccttccttttaaataatatttttaaaatactgctttcctgaaaaccatgctgcacttccacatgaagttctctctgacgttgagcttgatggaaaaaggatgcagaagtcaggaatagcaggtgctatacttattttggccagcagaggatgcacttgccctaaacagtcagagtgactcttccctaggaccctgtttatcaaattcttcatgtttaaaagccagggtctggccccccacttaacgagattgtctcaagtggcatttcatctgtaactcaattttacagaaatctagaaaatacaggctccccccaccctctccagccccaaaacacaaagcgtagtaaggctttcattgcaagcatcagtctccatctaattccacttccacatataaagattttaaaatttcaattaaaaaagaatctatggttgatcctttggttggacaacagtaagtaaatgttgattttaaactagtgagtcaactactctggcaatgttggtgtatctttggaaagaagggaagtgaatttattatgcaccatatgtccatgtgtggcacagcacttagctaaacagtattttggagaaaatatttggtcttcaacacacacctatataaaaaagattagttctatttcttcaatatgacctaaacttcatctcaagtccagttggtaagagaactatgaacctgtttttcctggtctgttgtacaacggttcccttgtggactaaacggtaatgtgttctgcatgaatccaagcacaactgacattcactgttttaaaaaacaaaaaagagaaacatttactacctttttcagatctcatttctgatggacctgaaaatattgtaagtgggtattttcttcaaatactcagagactgaattctaacatgtaaagaaaatgctgactcacacatgactcagtttgaaggttacagggaagactaaacatttatttagaagttacagtgtttgtttttacagagatatgttgccacggattattgattctggaaggttttttaatgctcatagtgctgtacacatcttggtctgttctcatgggcatcttaggaaaatgtttcccgtagcaccggatccagccatctgtgtgggtgtctccaggctgtgataccgtgccccttgctgttccctcatgctcgtgatgaaccatgtgcctgggatccttcctcttgccagcttatctgtgggcctcctgcagcctcgcctgccactgcagaggccccaggttaggagtctgtcccgcgccagcctgtgcggtgctttcctgggtgactcctgttaggtggcagcttctttattttccctctccaacctcaacgggtaggactccttatgtctctccagaattataaaacatatacatttatttacaagtgcataaatatataaatatggctataatagaaaaataaataccaattttctctgtc

SEQ ID NO: 119689 - DNA, 4411 bp, Homo sapiens
  Payload ID: 3472
  Gene Symbol: CFAP44
  Gene Name: cilia and flagella associated protein 44
  ENST ID: ENST00000465636
  CDS Start-End: 1-2974
tgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacaggatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgtcccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcagcatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtca

SEQ ID NO: 119690 - DNA, 5267 bp, Homo sapiens
  Payload ID: 3472
  Gene Symbol: CFAP44
  Gene Name: cilia and flagella associated protein 44
  ENST ID: ENST00000489244
  CDS Start-End: 1-169
ggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacatgactgtcttcttttagaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgtcccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcagcatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtcatagccctgagtgtcttatttattgcggtaaaaaattacccccaaacttagcttgaaacaacaaacttgtgatctcacccaggagtgagagggtttctgaggtccaggaatctggggacagcttggccgggtgttctggctcagggtctttcgtggagttgcagtcacactaggagctggggctgcagccatctgaagcttggctggagctggaggggctattagcaaattcactcccttggccattaggcagggcttcagttcctcgccatgtgggcctctccatagggccgcttgggatatgacttctcccagagcaagtgatccaagagtgagggagacagcaagagagaatgatgtatacaagagccacagtcttttacagcccaagctcagaagtgacatagcgtcactattgtcatatgggtcacaggctgaccctgtgtgatgtgggaggggactgaacagggtgtgaatgccaggtgggggtcaccggggccttcgtgggagctggcagccacaagaagcagctgcctggagagagtggctggtctctgagaaaggtcttgaggcgataccatccccttggtaattgtagagaatcaggagaagttacgttatcttcctgggcctcattttattatctgacaaatgaaggattggtagaatgggttccttcccattctgagattctgattctgattgcagcaagaatggacctacagtctacagaagagccacatcaggacttgctgtgcatttcaactgagaggaaagctaatcgggataattattcccaaactgagctggactaaatcactagttaattctacaatattcagggcttcattccgcatgtttgggaattgacgacagttaacactgaattactttattttgaattggacaaaatatgttgatagctttaggttcatttcaacttgattccaggcttagtcttaaatctgtagttaagttagagcatctgagtctttgggaagttaagcttcaaacacaagtagaccagcagggtgtggcatgggcagggtggctgggaagctatcctgctcctggcacacttccctgccttctgctgtgctcccagaggagcagcctcacctctgagggtaaggccaaaaatcagcctacactgagttacttgtgggtcaattgttcatataacttggctcttctgaactgtcatccatagtatcaccgatgatcaatctcagcattggaagaaaaagaaaccacagagtccagcccctctgtcacaacttcagagtaaaggagttgctcatgcctgccagccagcctgtcccaccacagcgggctccccagcttagggaggtctgtgagccatgtgctaaatttctctttagagctaaatccattgagtgctatgattccagtgctgtgcagaaagcagatgtttcacctatcacttcagaaaagttcaccagacttcattttgacagctaccttagatcatcaaggagaaaaaggaaaaaatgtaaaaaccagtggggctagaaggtgagttacagctcagattggggggcctctggatagcaaagcaatgactgagagcgtcagccctacccaccccagaagtgagctctgggccgtgatgccaggttgtctgaaatcacagtatcttattttttctcttctcttccctgctctgcttctcatttcctaacatttacctgttccttacagtccttccttttaaataatatttttaaaatactgctttcctgaaaaccatgctgcacttccacatgaagttctctctgacgttgagcttgatggaaaaaggatgcagaagtcaggaatagcaggtgctatacttattttggccagcagaggatgcacttgccctaaacagtcagagtgactcttccctaggaccctgtttatcaaattcttcatgtttaaaagccagggtctggccccccacttaacgagattgtctcaagtggcatttcatctgtaactcaattttacagaaatctagaaaatacaggctccccccaccctctccagccccaaaacacaaagcgtagtaaggctttcattgcaagcatcagtctccatctaattccacttccacatataaagattttaaaatttcaattaaaaaagaatctatggttgatcctttggttggacaacagtaagtaaatgttgattttaaactagtgagtcaactactctggcaatgttggtgtatctttggaaagaagggaagtgaatttattatgcaccatatgtccatgtgtggcacagcacttagctaaacagtattttggagaaaatatttggtcttcaacacacacctatataaaaaagattagttctatttcttcaatatgacctaaacttcatctcaagtccagttggtaagagaactatgaacctgtttttcctggtctgttgtacaacggttcccttgtggactaaacggtaatgtgttctgcatgaatccaagcacaactgacattcactgttttaaaaaacaaaaaagagaaacatttactacctttttcagatctcatttctgatggacctgaaaatattgtaagtgggtattttcttcaaatactcagagactgaattctaacatgtaaagaaaatgctgactcacacatgactcagtttgaaggttacagggaagactaaacatttatttagaagttacagtgtttgtttttacagagatatgttgccacggattattgattctggaaggttttttaatgctcatagtgctgtacacatcttggtctgttctcatgggcatcttaggaaaatgtttcccgtagcaccggatccagccatctgtgtgggtgtctccaggctgtgataccgtgccccttgctgttccctcatgctcgtgatgaaccatgtgcctgggatccttcctcttgccagcttatctgtgggcctcctgcagcctcgcctgccactgcagaggccccaggttaggagtctgtcccgcgccagcctgtgcggtgctttcctgggtgactcctgttaggtggcagcttctttattttccctctccaacctcaacgggtaggactccttatgtctctccagaattataaaacatatacatttatttacaagtgcataaatatataaatatggctataatagaaaaataaa

SEQ ID NO: 119691 - DNA, 236 bp, Homo sapiens
  Payload ID: 3472
  Gene Symbol: CFAP44
  Gene Name: cilia and flagella associated protein 44
  ENST ID: ENST00000465186
  CDS Start-End: 1-81
actgttgggtcagatggatatgttagggatgccaatggagccatatggaagcttgaccttagtttttcaaatattatctagtaagctgtctatctattctcagacccaggacccagaatgcctcttctccttccattctggagctattgaagccgtggctgtttctcctctcacttatctcatggccacaactgccttggactgctctgttcgaatctatgattttgctagcaaaa

SEQ ID NO: 119692 - DNA, 2218 bp, Homo sapiens
  Payload ID: 3472
  Gene Symbol: CFAP44
  Gene Name: cilia and flagella associated protein 44
  ENST ID: ENST00000461734
  CDS Start-End: 1-1259
tcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaagattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccatgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagaaccctggaaatggtctaagctaagtgttccaacagtttggtcctctgaagaagagcatcagcatcacctgggaacttgtttaaaatggcaatgccttccagggccctcgggaagcagatgttgtggcaagagaggaggtcactgaattgatccaactccaggcggaaaggatttcggccttaaaggaggagattgctcttttgcgtaggaaaggcagtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagag

SEQ ID NO: 119693 - DNA, 605 bp, Homo sapiens
  Payload ID: 3472
  Gene Symbol: CFAP44
  Gene Name: cilia and flagella associated protein 44
  ENST ID: ENST00000490481
  CDS Start-End: 1-358
cagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaata

SEQ ID NO: 119694 - DNA, 724 bp, Homo sapiens
  Payload ID: 3472
  Gene Symbol: CFAP44
  Gene Name: cilia and flagella associated protein 44
  ENST ID: ENST00000473143
  CDS Start-End: 472-724
gggagacagtcatcatactacactctcctttgtcctttgatcgtgtagtgtaccatatctgctttaggcataccagtctatcttcagagaccaggaagatataacagtgtggcagtttaagtaaccctcatagcaggcttgtaaaaagttttttcttcattcccattacagttggggaattcatataaagtttagttagctagttatatgtcagtactgggattcaaaccctaatctaactataaatctgatccaaatagaactagtgttccattctgcttgccaggcatatcgtagaagaatgttgaggaaacatagggtgtttagtatagagaagtgaagacttagaaggaaggtgttttcaaatatatgaaaagctgcattatagacagagggcagagaaaacctgttgtgtcgctcccctctttaaaaccctttaatggttttcagttgtcaaggaaataagaggaaatgaaggaaccagatgatcaggatactgatggggagaaatcagttacatcaaagagtgatgggaagaagtctctgaggtcttctaaatcagaatcaagatctcctgttcaagaagataacacatttttagaagatgacacagatgaaacatttaccaaaggggaaggatcatatttagaagaagactcagatgaggaacgtttggaaggaagtttgagttcatttcagtatggtgatttgcaaagcactacag

SEQ ID NO: 119695 - DNA, 2410 bp, Homo sapiens
  Payload ID: 3472
  Gene Symbol: CFAP44
  Gene Name: cilia and flagella associated protein 44
  ENST ID: ENST00000488854
  CDS Start-End: 67-180
agtaaacggaggcctccggcagacgctgtgaagagaggagccgcggcggtcagtaccttcgaggaaatgaaggaaccagatgatcaggatactgatggggagaaatcagttacatcaaagagtgatgggaagaagtctctgaggtcttctaaatcagaatcaagatgttcatccacataaaacttatttcacagtagctgaaaaagggagttttccagatattatcatctatgaatatccttctctgagaccatacagagtccttcgagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggatatgggattttgagacaatagacactgctgatgtaatagatgagactggattgttggagattgagcctattaatgaacttcaagtagacaagaatgtgaatctcttctctatgataaaaatgaatgaaactggaaataacttttggttggctcaggatgccaatggagccatatggaagcttgaccttagtttttcaaatattacccaggacccagaatgcctcttctccttccattctggagctattgaagccgtggctgtttctcctctcacttatctcatggccacaactgccttggactgctctgttcgaatctatgattttgctagcaaaactcctttggcccagatgaaattcaaacaaggaggtactgcccttgtttgggtaccccgaatggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcatcctgaaagtactttactaattatctgtgaaaatggctatattcttgaagctccacttccaaccataaagcaagaagaggatgatcatgatgtagtctcctatgaaatcaaagacatgtgcataaaatgtttccatttttcaagtgtcaaatctaagattctgagattaatagaaattgaaaagagggagagacaaagggagttgaaggagaaaataagggaagaaaggaggaacaagctagcagcagagatgggagaagatggagaaaaagaatttcaggaggaggaagaggagaaagaggaggaggaggaggaagaagagccattacctgaaatatttattccgtcaaccccctctcccatcctctgtggattttactcagagccagggaagttctgggtttctttgtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagtaagcctaatataaacttgatttttattttaacatatgctatttctggatagagatgactattttcccaacaagtagaaacacttaaaatcatctttcttttttgtttgtttctttcaaaatttcaatagccatttattttgggcatcttttaatttgtatgtggggtttatcccttttaatcagttaagattcttgttgacacaaattgttttacatcaactgttgttatagaacacatgaaaggaatacatggggaagaaataaagtagaacccaagagttcttttaagttttc

SEQ ID NO: 119696 - DNA, 241 bp, Homo sapiens
  Payload ID: 3472
  Gene Symbol: CFAP44
  Gene Name: cilia and flagella associated protein 44
  ENST ID: ENST00000489938
  CDS Start-End: 1-31
taaatcagaatcaagatgttcatccacataaaacttatttcacagtagctgaaaaagggagttttccagatattatcatctatgaatatccttctctgagaccatacagagtccttcgaggttctgggaaatggcttttacgttcaccggtctcaagctgcagggatcactaggtcgatttggcaaaacaatcactactgatatagaaggctacatggagctcccagatgggaaggtgctc

SEQ ID NO: 119697 - DNA, 1842 bp, Homo sapiens
  Payload ID: 3473
  Gene Symbol: CFAP45
  Gene Name: cilia and flagella associated protein 45
  Uniprot ID: Q9UL16
  ENST ID: ENST00000368099
  CDS Start-End: 66-1721
cactagggccttggcggcgccgaggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaa

SEQ ID NO: 119698 - DNA, 1976 bp, Homo sapiens
  Payload ID: 3473
  Gene Symbol: CFAP45
  Gene Name: cilia and flagella associated protein 45
  Uniprot ID: Q9UL16
  ENST ID: ENST00000426543
  CDS Start-End: 457-1857
gatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagatctcagaatggccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgacttt

SEQ ID NO: 119699 - DNA, 896 bp, Homo sapiens
  Payload ID: 3473
  Gene Symbol: CFAP45
  Gene Name: cilia and flagella associated protein 45
  ENST ID: ENST00000479940
  CDS Start-End: 473-896
gtgtggctgaggagatgatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagatctcagaatggccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagc

SEQ ID NO: 119700 - DNA, 1844 bp, Homo sapiens
  Payload ID: 3473
  Gene Symbol: CFAP45
  Gene Name: cilia and flagella associated protein 45
  ENST ID: ENST00000476696
  CDS Start-End: 28-1323
ccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacagctattttgtgccctcactggtcccctgccaacattcccaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaa

SEQ ID NO: 119701 - DNA, 1825 bp, Homo sapiens
  Payload ID: 3474
  Gene Symbol: CFAP46
  Gene Name: cilia and flagella associated protein 46
  Uniprot ID: Q8IYW2
  ENST ID: ENST00000368585
  CDS Start-End: 340-1557
gggcacacaggagccctgagcggggagaggaggcccgcgcggagcccccggcgtccccccacgccgccttccctcccctttcttcttcccgcccctcgccgggggtcgctgccctggtgtctcactcccgcggagctggcggggggcagggcgggggcgcggcgttgttcgccttccccgaagtgtggccccgccgccgacccgtagccccgcgtccgcgtccctttcggtctccaggcaaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagtaagtggcttcatgacactgctgcctggggatgaggcgctgctcaccgtgcagttggacaaaaggcaaagaaaggaagagcagttcaccaggccacggcccccagggcttcggtccgtggttggcacattgccgtctttcctacctgtgttttgcacagttgcagttagatggtgtttgcaattttacacctgcccgtttctctttacctttcttgtggccacgggtccacagcaccacagttgtttctagagtccaatttacggacggcgtaaaatttcatgatgctgatgatccagaacatcctccaccagtcccattattggacgtgtaaatcacaccggcagtgcctcgttacccgcagttcactttctgcagtttgttacctgcagacagctacagtatgaaaatattaagctattctgagggagaggccacagccacatcacttctgttacagtatagtgttatgattgtatcttattattagttattgttataaatatcttattgtgcctaa

SEQ ID NO: 119702 - DNA, 8278 bp, Homo sapiens
  Payload ID: 3474
  Gene Symbol: CFAP46
  Gene Name: cilia and flagella associated protein 46
  Uniprot ID: Q8IYW2
  ENST ID: ENST00000368586
  CDS Start-End: 102-8249
caaccgtggccgggtcctcgcggctggagaacccaaccgacagtgggcggcaggacgcaccgcggaccccggagagagcggacgagcagggcgccggcgccatggacctggtcatcacgcaggagctggcccgcgccgagagccagcaagatgctgcgtccttgaagaaggcctacgagttgatcaaatcggccaacctagggaaatcggagtttgacccctcagagagcttcagcccagacctgtttgttctgtgtgcagagcaggccctgaagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggaggaatttgaaaattgcgtgactgagtacatgaaggccataaactttgccaaaggagaaccgaggtactactttttggtgtacaatgcatcagtcctctactggcagatggtgaggccgttcctcaagcctggatatcgtcaccatctgatccccagcctttcccaaatcataaacgtgctgagtcagactgaggaggaagacaaggagtggcgtgctgagctgatgctggaacttctggagtgttatctgcaagccggaagaaaggaggaggctgccaggttctgctccacggcagctccgttcattaagtctcacgtgccacagaaataccggcagatattctctgttatggttcgtcatgaattaatggacgaacttcagttaaaggaagaaaagaaaaattccattagcctgtcagtcactttctatattaatatgctaaaggcaaaagcggagcaaaatgatttaccaggtgacatcagtgtcattctgaggaaggcctacagacacttaggtcattacaaccaccagcgctttccctctatcagtgaagaaaaaatgcttttgctttttgaattggcgcgtttttccttgaccttgaaatgcatggagatctcctctgcctgcctctcagacctgaagaagatggaaagcaaagatcctgggaagcttattgaaatggaatgtctggagtgtgaatcggaagctttaagacttgaaagtaagatgaaagtgtacaaccgagcggctgttgaggcccagctggatatcatacagaggctagacgtcgcgctgcagcgagccgtgcgcctgggcgacccccgggtcatccacgtggtgtgcgccacgcagtggaacacctgcctgcccctgctgcagcacaacctgcggcaccacctgcggaagcccctggctggcgttgcggacgtgctggagaagctggacagcctcatgacgcttctccgctgtcaagtgcacatggagatggcgcagatcgaggaggacgaggaccggctggagcccgccacggagcacctccggaaagccgcgcgcctggacagcctgggcctctaccgggacaggatccagatggcctccacccggctgcgtctgtgcaccacgctataccaggcccctgagcgcgcagaggacaaggccatcatggccgttgagcaggcaaaaaaagctacaccaaaggacagcgtcaggaagaagcgggccctcctggtgaatgcaggcctggccttagcccctgacgcgtttcagattgtgctggacagtgagaatgaggccaaagtctccaccgggaagaacaggggccggttcacctacctctgtgcgaaggcgtggcaccacaccgtcagcgtggacaaagctgccgggcacctgcggcgcctgggcaacgaaaacgacaaggagaggatacagatttgggcagagctggccaaagtggcccggaaacaaggcgtgtgggacgtctgtcggacggcgagccgcttctgcctcctgtatgacaacgtcaaggtgaagaagttgaggctgcggcgagggaagaagaagcgaggtagggacggctcggtgcaggacacctggagccagcctgaggtcgtcctgcagaggcaggtgtgccccgacctgctgcggaagttcgcggaggtggggttcatccatgctgaggccacggttcatttgctgcggtcagaaggtgtagagctgaatgaccgggccatcccccccgaagacctgagccagcacccagctggctacgtgcctgagcccccggaggtgaatgctgagtggatcacatacagaacctggatcgagagtctgtcccggtgtgccatgaataactggctgcgctccgcagagatcggacaggagatccaggaggcgtggattgtgcagaacgccgtggtctacgtcctgaaccacaaccaccacctgatcctggccgggcggcagaaggagctggtggacgccctgtaccacctcctgagcatcgttaaggccacaggccacagtggggaccccgtgatgctggtgacgctctgcaacaccttggcgcgaggcctgatcatcagctggattccagtccaggctgccgagaagtccaggaaattcatgcgaccaaacgcgtttcacagcccactggacgcaggagccacttccgagatcaaaacagcggtggaggtctgcgagtttgccctgaacctgaccaatgggagtgcgcccgaggagacggtgcccaccggcacccggcagcagcttatcgccacctgggtcaaggccaagcagctgctgcagcagcagattgggccacggctgggcaccgaggagcagggcaccaatgaggatgtcagctcggtgaccagagtcctcgttgccttggaaatgtactcatgcaacgggctgggcctcatggacttcactgtcccctccctggcccagttggtgaaaatggcttccgagtgcaactggtcggaccccctggtggagctgcagaccctgacgcggctgacccacttcgcccatgcagcgcgtgaccatgagaccaccatggcctgtgctcacagggctctggagatgggcatcaagtacctgaagaaatttgggcccgaggagtcccggctggtggcagagatgctgtgcacagccacggccatccagggcaggagcatcatggaaaacctgaagggccggaagcagctgcgactggtggcagccaaggccttcacggagagcgccaggttcggaggcatcgcgggcagcagcgccctggtgatgctggccgcgcggcattactggaacgcctggctcccactgctgtcctcagccgtctacaggaagaaggccaagggtgccctgaagaggctcatcggcatcatcaacaagacagaggccagaaagcaggagaaaggaaagacgctgcttctgcaccagtggcccacggccgacttccagggtggcgggacgaccgaaggatattttcttccaggggctgaggacgacctggcgctccgtgctgcgctctacggcctgctcttccacagccatgccgaccaggacgactgggagggcggcctcaaggtgctggacgaggctgtgcaggtgctgccaaggacggcccaccgcctcttgatcttcaagcacatggtcatcgtgaaggccaagctcgggcagaatttttcgatggaaatacagaaattcaaggccgagagtgaggactacttggcgcgcatgtggcaccgcctggccctgaactcgccgagcgtgtctggagagctggcctgctacaacaacgccatccaggccttgcagaagcctgagatggagtggcagaaggtggagtacctcatggagttcggccagtggctccatcacagacactttcctctcgaggacgtggtcttccacctccgctgggctgtcgagatcctgctggccatgaagccgcccggcgatgtccctgagccacagcccacgccggatggggagtacgtggctgtggagatgcccccacggagccccgtgtccgaggccgaggaggcggtgtccttggagcagctgcgtagcgtgcggcagctggaggcgctggcccgcgtgcacatcctgctggccctggtgctgtcgccgggcgccgagggctacgaggactgctgccttgcagcctacgccttcttcaggcacatctggcaggtttctttgatgacagcaggaaaatcagttctggaaaacagacccctggcagcaaccagctcacatctgttattgcctaaaaaagagaaggagaatgagaggagtaaagagaaggagaaggagaggagtaaagagaaggagaatgagaggagtaaagagaaggacaaggagaagggaaaggaggagaaagtcaaggagcccaagcagtctcaaagcccagctcctatcaaacaactggaagacttacccatgagcatagaagagtgggcttcctactcctgccccgaggaagtgctgtctgtactgaaacaggacagaagtgactctactgtgaacccctcaagtatccagaagccgacatacagtttgtatttcctggaccacctggtcaaggccctgcagaagatgtgcctgcacgaactcacggttcccgtcctgcagttgggggtgctgatttcggactccgtggtgggaagcaagggcctgtcggatctctaccaccttcgcctcgcccacgcgtgctccgagctgaagctgagagaagcagccgcgcgccatgaagaggcggtcgggcaggtgtgcgtcagcgagctggagcaggccagctgcagaaaagagatcgcgttgaaaaaagagaaaaataaggagcctttattagaagaaagcctgccagcactgaatgagcagacacttcctgtccagcctggggagatcaaaccactggacgccaaggacaagattttgaagatgaatggggagaccgggagggacctggatgggacgtcctttccccacctgtggatgctgaaggcagaagttctgctggagatgaacctgtaccagcctgcacggctgctcctgtcggaggcttacctggctttccaggagctggatgagccttgtgcagaggcccagtgcctgctcctcctcgcacagttggccaacaaggagaaaaactatggacaagccaagaaaatgatcgcacaggcccagcacctgggcggaagtgaggagttctggtacaattccactctgaccctggcagaggcgctcttgtccatggaacactcaggaagggaagctacggtgtgtcacatatttcagaagctcatcaatgccttcaagatcctcaagaaagaaagaccaaaccgattgcctttactggaattcatgatcacagatctagaagccaggtgcctgagcctgcgggtcagagttgcgcagcactcagcggtcactgaacccacagagtgctcgttgctactgaaagagatggatgatggcctgttggaaattgagagaaagtttatcgactgtggctgcaaagagaattgtgttgacgtaaaactagagcgtgcgaagatcaagaggttacgtgcccagaacgagaaagatgaagaacaaaaaactgcgtattacttggaagcgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagcca

SEQ ID NO: 119703 - DNA, 610 bp, Homo sapiens
  Payload ID: 3474
  Gene Symbol: CFAP46
  Gene Name: cilia and flagella associated protein 46
  ENST ID: ENST00000448925
  CDS Start-End: 1-461
agacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagacagtgaaaagcacgagggagcgcgcggaaggccctgacctcggctgggattcgggggtgatgacattctgtgactgagtgctggctgtgcagacgtgccccggttgtgaagcttccccgagcgctacccttgcggtacgtgcagttttctgcacttcggtatcaaataaaattaaaaataaatcga

SEQ ID NO: 119704 - DNA, 3608 bp, Homo sapiens
  Payload ID: 3475
  Gene Symbol: CFAP47
  Gene Name: cilia and flagella associated protein 47
  ENST ID: ENST00000297866
  CDS Start-End: 67-2997
ggtcgtcgacgctaatccttggccggacggatccacatctgttttctggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggttgattccatcctgtcaattggaaattgaatcagtagttaattttggcacactggttgccaatagtaaagtatattctaaagagattactatcactaaccatggcaaagctccaggcatatttaaggcagaataccacggccaattacccatcctcatttttccaactagtggtatcgtggatgctaagtcatcaatggttattaaagtagatttctgtgcagaccagccaagaattgtagatgaagaggcaatagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattgggtacagatattcaacaaagaacagatattgctttaaataatctcacctacataagaaaaataaagaacatagatactactatcattatctcctgtcttcctaatgaagggactttacaaccttatcaaaagactgtaattacattttgtttcaccccaaagctaatggctgttggtaaaaaggatattggaccttcatacagacaggactatgctctctttttgagatttgagtccgtaggaagtaaagatggatttttgagagatgatgactataaaaccatcaaaagtgaacgatttcagaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtatattgccttcgatccgtaatcccacgggaaagtttgtggtcaaagacttggcaaaacgcaagaattatgcacctgtagcaatgcttcaatcagccatgacacgcactcacaatcatcgctcatgtgaagagccagtgaaggatatgctattagcctttcccaatgaccgagctgcaactatcaggtctaaagaccatcataaacatttcaggccaattttcacaaaagttccaagatttaactatgtgaatcatgattttgcatatactacatttgaaaaacagcaaaagaaattacatgaaaactattatgcaatgtatcttaaatatttaagaagtgtgcgcttgcagaagaaacaagcagagagggagcgcatgtattcatatgatgatacagacataggcttagagccaggatcaggtctaaagtcaccctcactctcagaagcggaaatagaagaggagctgtcttcagcagcaaattcaattagagcgaatcgattgttaaccaccaggggtatagcatctcaggaggaagagtctgtgagaagaaaggttctcaaaggacttaaatcagaaccatccactccacaagaaaaacatgattgcagcttaatgttgacaccaaagcaaattcatcaagtaattgttgggccttctgtccttaactttggtaatatttgtgtgaactctccaaatactcatctacttcatgttattaatatgctacctatgcatgttttgctccagttagatactgatttagaagaacttcagaagaccaaccaattttcatacgtgattctacctacatccagtacttatatttcaatggtatttgactctcccaccattggaaaattttggaagtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggcactgttgaagcatattcctcactggaatgtgaagtaacttggcagcagggcttcagttctccagaagaaggagaatttattcttcatgtctttcaaggaaacgcgttgaagctaaaatgtgttgcacatgtaattattttccttgaacatggtttttgttttgagggctatgaatttgttgggtatacactggtgtatatagttacctatatctagaattaactgtaaaacccaagactttcatgcaacagtactagtttttttgttagagcctctataaatatgtaatatcatcatgggagccattgaaatgaaattattttattaagagacacaaaaagtattttcagagaatatacttgatggattaaaaatgtgagtagagggaaagctgtaatatgcaattttaacctttttctggtacagtccagagggccttaaattcatgactcaatcaccaagcatgattttacatgtgtaccaaatttcccactcaatgttcttagaaatattaaagaagccaaatgctcttttactaaaccccatctatatttctaggacatgatgatactcttacatatttcagctgtggaggagtttttagcctcaagagatgagaaattcatctacttttagtgatggcaagtgacagaactcagtatggtttttcttctaagcctaaaataagctgggtcctactacttttcattatgtgtaaattagttttattttttaaaaactttctattgaagtataacatgcatatgtatatgtatatgtggagaaacatgaagtgattaaataaaatattcatttgtttgtcattc

SEQ ID NO: 119705 - DNA, 1549 bp, Homo sapiens
  Payload ID: 3475
  Gene Symbol: CFAP47
  Gene Name: cilia and flagella associated protein 47
  ENST ID: ENST00000313548
  CDS Start-End: 41-1549
tgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagtaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctga

SEQ ID NO: 119706 - DNA, 9943 bp, Homo sapiens
  Payload ID: 3475
  Gene Symbol: CFAP47
  Gene Name: cilia and flagella associated protein 47
  ENST ID: ENST00000378653
  CDS Start-End: 67-9630
ggtcgtcgacgctaatccttggccggacggatccacatctgttttctggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggttgattccatcctgtcaattggaaattgaatcagtagttaattttggcacactggttgccaatagtaaagtatattctaaagagattactatcactaaccatggcaaagctccaggcatatttaaggcagaataccacggccaattacccatcctcatttttccaactagtggtatcgtggatgctaagtcatcaatggttattaaagtagatttctgtgcagaccagccaagaattgtagatgaagaggcaatagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattgggtacagatattcaacaaagaacagatattgctttaaataatctcacctacataagaaaaataaagaacatagatactactatcattatctcctgtcttcctaatgaagggactttacaaccttatcaaaagactgtaattacattttgtttcaccccaaagctaatggctgttggtaaaaaggatattggaccttcatacagacaggactatgctctctttttgagatttgagtccgtaggaagtaaagatggatttttgagagatgatgactataaaaccatcaaaagtgaacgatttcagaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtatattgccttcgatccgtaatcccacgggaaagtttgtggtcaaagacttggcaaaacgcaagaattatgcacctgtagcaatgcttcaatcagccatgacacgcactcacaatcatcgctcatgtgaagagccagtgaaggatatgctattagcctttcccaatgaccgagctgcaactatcaggtctaaagaccatcataaacatttcaggccaattttcacaaaagttccaagatttaactatgtgaatcatgattttgcatatactacatttgaaaaacagcaaaagaaattacatgaaaactattatgcaatgtatcttaaatatttaagaagtgtgcgcttgcagaagaaacaagcagagagggagcgcatgtattcatatgatgatacagacataggcttagagccaggatcaggtctaaagtcaccctcactctcagaagcggaaatagaagaggagctgtcttcagcagcaaattcaattagagcgaatcgattgttaaccaccaggggtatagcatctcaggaggaagagtctgtgagaagaaaggttctcaaaggacttaaatcagaaccatccactccacaagaaaaacatgattgcagcttaatgttgacaccaaagcaaattcatcaagtaattgttgggccttctgtccttaactttggtaatatttgtgtgaactctccaaatactcatctacttcatgttattaatatgctacctatgcatgttttgctccagttagatactgatttagaagaacttcagaagaccaaccaattttcatacgtgattctacctacatccagtacttatatttcaatggtatttgactctcccaccattggaaaattttggaagtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggcactgttgaagcatattcctcactggaatgtgaagtaacttggcagcagggcttcagttctccagaagaaggagaatttattcttcatgtctttcaaggaaacgcgttgaagctaaaatgtgttgcacatcttggtcgcaccaaggttttacttttgcagccaaggatactctttagtaattgccctcaaggtttaacaacttggaggaaagccattcttcaaaatgtaggacaaaaccatgcttatttcaaggtttgtagtcagagtcttttgcctatcattaatattattccatcgcaaggaatagttccatttgggggaataactgttctcaatatctcctgtaaacccactgtggcagaaaagtttgatacaagagcaaaggtttctattcgtcatgcgaatgttatagaccttaggattggtggatctgctgaaattgctgatgtagaaatcaatcctgatgtatttaatttcagtggcgcctatattggtggtacccagattattccatttgtaataaaaaacaaaggtataacacgtgccagagtggagtttaatctaaaagactttccggatttttcaatggatcttaaagacaaatcagaagaatttaaagaccctgcagttccttatatatattctttggaattagaggaaaatacatctctggaatgtagcataacattttctcccaaagaagtgacagtagttgaattcatcattcaagttcagattaatttctttgagtcttcaaagctctacactaaatatttgtccagttctccttcgaatccaaaaacagtaccacttatccgaccatgttacgttcaagctactgcattgcaatcaccattgaacttatctagtactaagtttgtatttgaaatccctttacatgagatgaatcctaataacaaggtcacaaaaactcagaatcttgttttatataatattaccaaacaccatgtgacatggactttggatcttagtaatactggcaaacttttcaaagacggcacattcaagttcagtgtactgaatgggattctacgaccaaatgaaaagtataatgtttccataagtttctgtccaaatcgtcctgggacatacacagcagatattcctatgcttttaaattatattccagtttgctataaaatattacatcttactggggaagtaaaatcaccagagttattgtttgaccctccatttatatttttcactcctgttcctttggatataacaactgtaatggatatcaacattttacctcaaaactatttcagaaattcaactctatgtgtccagattcccacagtaaggcttcttgatggtgaagagattcaccctctttctgtgaaatttccaaaaggcagagtcatcccaggctctcacagtggaattaataataagctcacttgccacctcagtttcaagtcatctaaacctgtgtcattttttaccaatcttcttttctgtgatgacagaaaaaactggttttcacttccagttactgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagtaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggccacagacatctgtgacccaaatccaatcctgatgctcatgctttgtgtctacatgtatgaaagactccctacatatctccctaagaaggtggtgtcctttgaatgtactctacatgacacggtgctgaataagattctactgaaaaattccagctcgcgaaacttagtgtataatgctagaattgttggaagagatgctgctgacttctccctttcccaaaaagggaatgttgtgacaatttctccaagaaatgaaattaatgtcactctgaaattcaccagtcgctttattcgtcctgctgaagcttcactactattaatttcaaaacccaagaatgcagtaagaggaattacaatgacttttgctcttaaaggcaaagtcctcgattttaaagccattgacattataaaatgcgaaagcccatgttatcaatttcaggaagtcactgtaaatgtgaaaaaccccttccatacggctggggacttcagtgtcattttggtggaatcctcaacatttgtctcttcgccaacgaagttaactgaatccaggcaatacccgaaacatgatgatgatatgagtagcagtgggagtgacactgatcagggctgttccgattccccaaatgtcttacatacctcaattaagtccacttttatcagagagttcttctgctccatgcatactgttcacctgggagtgaaaggaacttcaagcctagagctccgctttcttccctttaacatgcacgtgcgctactgtgtcatcatcttgagcaacaaaaagattggacaattaatatatgttgcggaaggaaaaggtatgacccccttgccttccagttgccttccaatgaatacgtcttcaagtccagtttattacagcactactcgagaagaagggcctaataagaaatacccagttctgtatttgaaatgcaaaccctatcaaatcctgtatgtggaccttaaattgccaatgactaatgaagccaaggaaaaggctttggcttttgcagcacagcaacagatgtcgagtattgagtatgagcgaaggttgatcacaggcactctagagagcagtagtatccgtgtggccatcgccctcctgggactgacgaagatcgagactcttatgctctttcgtatctcaaagttgaggaagcctaagaccgtttcatacacaacagaagtgagccttccaaagtatttttatatccctgagaaaatctccattccttggattccagaacctcaagtaattaaactttcaaaagcaaaagcttcagatggatctgttccacttcctttgcaatttcttcctctccaatctggacgctacccttgtaaaattttattgaaatcaaggtatgatgtgcgtgcctattatgttgaaggtattgtgaatgaagaacaaccagaggccaaatttgagtttgaaacaccagcatttgaagcccttactcagaatattccaataaaaaatcaaacaaacgataaatggacctttcaagttactatagaaggagaatggttttatggacctgttgatttacatgttggaccagatgaaattgtggagtatcctctcacattcaaacctatttttgaatgtgtcattacgggtaaacttattctacaaaatgaagtagatggtagggagcacatctttgacataaaaggggttgggaaaaaaccttcggccttggaacacatcactgtggaatgtcaagtggggaatgtgacacaaaagcatataacattgcctcatttcacaaatactgccctaacatttaaggtaactgcagatcttccaatagtgtggggaaatccacaaattacagtatacccttataaagaaattctgtacctgattcatgtgcgcccttggaaacgtggtatattgaaaggtacaattacattttctactacaagaagatgtactacaagaaggaaacatgatgattatgaggaagacacagatcaagatcaagccctctcctgtcttgattcaataacagaacaatctagcattttggatgatgcagacacatatggtaattttaacaatttaagattctggtataatcttgagatccatagcactcctggaccacccatagagattatggaaatgacatgtattgctctggacagcacttgcattgaaatacctctctctaatccaaaagatagaggtcttcacttagaggtgcagttaacgagtgctgcccttaatggggataatgaaattatcctgagtccactacagtgcaccaaatatattgtatggtattctccagcaactacaggctacagcgatgaaagcattatttttcagcctgaaatggctgaagagttctggtatttactgaagttaactattgaattaccaaaaccaaccacaatgccagaaatacagtgcgaccttggcaagcatgtcactcagatcattcctttagttaattgtacgcatgaaaccttaaaattgcaagtaacaaacagtaatcctgaaaattttgtcctggatattaacagaaaatcacaactgatcatatctcctcactccaccacagaattacctgttctcttttatccttctgcacttggaagagctgatcatcaagcttgcatcaacttctactgtactcagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatgaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgtaga

SEQ ID NO: 119707 - DNA, 2906 bp, Homo sapiens
  Payload ID: 3475
  Gene Symbol: CFAP47
  Gene Name: cilia and flagella associated protein 47
  ENST ID: ENST00000378657
  CDS Start-End: 695-2596
gtttgaaacaccagcatttgaagcccttactcagaatattccaataaaaaatcaaacaaacgataaatggacctttcaagttactatagaaggagaatggttttatggacctgttgatttacatgttggaccagatgaaattgtggagtatcctctcacattcaaacctatttttgaatgtgtcattacgggtaaacttattctacaaaatgaagtagatggtagggagcacatctttgacataaaaggggttgggaaaaaaccttcggccttggaacacatcactgtggaatgtcaagtggggaatgtgacacaaaagcatataacattgcctcatttcacaaatactgccctaacatttaaggtaactgcagatcttccaatagtgtggggaaatccacaaattacagtatacccttataaagaaattctgtacctgattcatgtgcgcccttggaaacgtggtatattgaaaggtacaattacattttctactacaagaagatgtactacaagaaggaaacatgatgattatgaggaagacacagatcaagatcaagccctctcctgtcttgattcaataacagaacaatctagcattttggatgatgcagacacatatggtaattttaacaatttaagattctggtataatcttgagatccatagcactcctggaccacccatagagattatggaaatgacatgtattgctctggacagcacttgcattgaaatacctctctctaatccaaaagatagaggtcttcacttagaggtgcagttaacgagtgctgcccttaatggggataatgaaattatcctgagtccactacagtgcaccaaatatattgtatggtattctccagcaactacaggctacagcgatgaaagcattatttttcagcctgaaatggctgaagagttctggtatttactgaagttaactattgaattaccaaaaccaaccacaatgccagaaatacagtgcgaccttggcaagcatgtcactcagatcattcctttagttaattgtacgcatgaaaccttaaaattgcaagtaacaaacagtaatcctgaaaattttgtcctggatattaacagaaaatcacaactgatcatatctcctcactccaccacagaattacctgttctcttttatccttctgcacttggaagagctgatcatcaagcttgcatcaacttctactgtactcagtttacagaatggaaattctacttatctggagtaggactatttccccagcctctagacacggaaagaataaccacacgcattggtcttcagtcaactattgttatacctttcaaaaatcccacaatggaagatgtcctcattgatataatactgacaagtgtggaacatcccaggaatcttgtcatggatcattgctgggatagcttcatctatgagagttctgccttcagatttagttctccgagtgaaatacaaggaattgcactgcctcctaaaggaaatatagatatctcattgttatttatacctcaaattatgaaattacacaaaacaatggttattattgagatgacgaaagcaaatggaaaatattggcctattgacaattttgatgagttggatataaaatttaaaagtattgtgggaatcgacagcgaagaaatccaagcaatacactggatataccctattgttggactcccacaagcaccacctcctaaatctcccccagttgtcatacaatgtcagtccaggaagcgggcagaagagaaggtagaaatcatactgaatgctggttttttcggatttagtcttactccagatctgacagaagttttagtgattccaaaaagaaattcacataatttttgtgaggatcccaatgaaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaaggtctcacataacactgaaaatagagtgcgtaacagaagggatctggaagtttcccataatgttgatcgctactgaacctgatacggatgctgtcattgacattgaaggagttggtttatttaaggaatctgtttttgaacttaggctgaaaagtcagacaagaaatcctgagccgttcaccgcacacttcctacctggcagcgatctggagttttttgtaaaacctcaggctggagaacttcttccttttaacacaaacggaactctcatcactgtaggatttaaacctaaaatgtactgtaggaaatataaagcaacattagtaatacagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagttatgaatgttttttggttgcgaacattggaattggttcacttttaaagtgcaggtgtatatttgtggtaaaacgaaatataatttaaatgacaacagtatttccaataacagcgttgctaataaagctaaatgtctcatgt

SEQ ID NO: 119708 - DNA, 3468 bp, Homo sapiens
  Payload ID: 3475
  Gene Symbol: CFAP47
  Gene Name: cilia and flagella associated protein 47
  ENST ID: ENST00000493930
  CDS Start-End: 20-2284
ggctaccgagagggcagccatgaacacccaaaagggttccctcaccataaacgtccacagaggttccctcgccatgagcatccaaaggggttccctcgtcccccgggatatggatagctcgggtagagacatgcagctgcgggtgatcccggctgaggtgaagttcctggacacgatggccgggagggtgtaccgcctcccgattactgtgcataatatttgccgctggaaccagaaaatccgatttaaggagcccgtcaagccacagttcaaactgatgttgaccagtctggataaagaacttgcttctggccttcagatgacagctatggtggaatatcatcctgataaagacgaagacacttttgaccggctacttatttcaatagaaaataaaacaacagaaattcctctaattgggttgattccatcctgtcaattggaaattgaatcagtagttaattttggcacactggttgccaatagtaaagtatattctaaagagattactatcactaaccatggcaaagctccaggcatatttaaggcagaataccacggccaattacccatcctcatttttccaactagtggtatcgtggatgctaagtcatcaatggttattaaagtagatttctgtgcagaccagccaagaattgtagatgaagaggcaatagtgattttgcaaggtcaacctgagatgctcttgagtatcaaagctcatgtggttgagcagattattgaattattaagcatgagtagtgacagaaggctggaatgcatacactttggtcctgttttcttcggatcatcaaaaattaaacatgcacgtgtatacaataatagcccagagcccataaattgggtggccatcatacaagatgatgccgtgggagaagaattgggtacagatattcaacaaagaacagatattgctttaaataatctcacctacataagaaaaataaagaacatagatactactatcattatctcctgtcttcctaatgaagggactttacaaccttatcaaaagactgtaattacattttgtttcaccccaaagctaatggctgttggtaaaaaggatattggaccttcatacagacaggactatgctctctttttgagatttgagtccgtaggaagtaaagatggatttttgagagatgatgactataaaaccatcaaaagtgaacgatttcagaaagtggaattagcactgacaggcacaggacttcctgttttactacagtttgatccaggaccagttcttaattttaaaccttgtttcatgggtgaacgttcagaaattcagtgcatcataaaaaatcaatgcgaattacttcctgtgacgtaccactttaaaaaaactgcaaattttgaaattgatcctgaaaagggcaagattactggagggggtatggtggatgtgatgtgttcatttgttccacatcaacttggagtcttcaaagtgaagcagatgatagagattattggtttagtggcagaagaagatttgcaatctttgtcggtaaaatctttccatcacgtatatttagctttcaacagcatctgtaaagcttccaccaagaaagttgtgatgaaatttgatcctggtatattgccttcgatccgtaatcccacgggaaagtttgtggtcaaagacttggcaaaacgcaagaattatgcacctgtagcaatgcttcaatcagccatgacacgcactcacaatcatcgctcatgtgaagagccagtgaaggatatgctattagcctttcccaatgaccgagctgcaactatcaggtctaaagaccatcataaacatttcaggccaattttcacaaaagttccaagatttaactatgtgaatcatgattttgcatatactacatttgaaaaacagcaaaagaaattacatgaaaactattatgcaatgtatcttaaatatttaagaagtgtgcgcttgcagaagaaacaagcagagagggagcgcatgtattcatatgatgatacagacataggcttagagccaggatcaggtctaaagtcaccctcactctcagaagcggaaatagaagaggagctgtcttcagcagcaaattcaattagagcgaatcgattgttaaccaccaggggtatagcatctcaggaggaagagtctgtgagaagaaaggttctcaaaggacttaaatcagaaccatccactccacaagaaaaacatgattgcagcttaatgttgacaccaaagcaaattcatcaagtaattgttgttagatactgatttagaagaacttcagaagaccaaccaattttcatacgtgattctacctacatccagtacttatatttcaatggtatttgactctcccaccattggaaaattttggaagtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggcactgttgaagcatattcctcactggaatgtgaagtaacttggcagcagggcttcagttctccagaagaaggagaatttattcttcatgtctttcaaggaaacgcgttgaagctaaaatgtgttgcacatgtaattattttccttgaacatggtttttgttttgagggctatgaatttgttgggtatacactggtgtatatagttacctatatctagaattaactgtaaaacccaagactttcatgcaacagtactagtttttttgttagagcctctataaatatgtaatatcatcatgggagccattgaaatgaaattattttattaagagacacaaaaagtattttcagagaatatacttgatggattaaaaatgtgagtagagggaaagctgtaatatgcaattttaacctttttctggtacagtccagagggccttaaattcatgactcaatcaccaagcatgattttacatgtgtaccaaatttcccactcaatgttcttagaaatattaaagaagccaaatgctcttttactaaaccccatctatatttctaggacatgatgatactcttacatatttcagctgtggaggagtttttagcctcaagagatgagaaattcatctacttttagtgatggcaagtgacagaactcagtatggtttttcttctaagcctaaaataagctgggtcctactacttttcattatgtgtaaattagttttattttttaaaaactttctattgaagtataacatgcatatgtatatgtatatgtggagaaacatgaagtgattaaataaaatattcatttgtttgtcattcatata

SEQ ID NO: 119709 - DNA, 269 bp, Homo sapiens
  Payload ID: 3475
  Gene Symbol: CFAP47
  Gene Name: cilia and flagella associated protein 47
  ENST ID: ENST00000630521
  CDS Start-End: 1-269
aaattcctaaaatacatgaattcgagtatgaaattcaatttgaatctgaagctatgaagtctaagttggaatcctgtgtagctttatatatgattgaaaaatcttatgatattatggctaaaaggataacatttatcttcaatctggtattcacaccaaagaaaccattaagaaatcctgagccgttcaccgcacacttcctacctggcagcgatctggagttttttgtaaaacctcaggctggagaacttcttccttttaacacaaac

SEQ ID NO: 119710 - DNA, 2193 bp, Homo sapiens
  Payload ID: 3476
  Gene Symbol: CFAP52
  Gene Name: cilia and flagella associated protein 52
  Uniprot ID: Q8N1V2
  ENST ID: ENST00000352665
  CDS Start-End: 70-1932
gttaccataacgaccagaagacgctgcagccactagggaggagagcaaagtaatcagaacctcccaaggatggataacaaaatttcgccggaggcccaagtggcggagctggaacttgacgccgtgatcggcttcaatggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataatttgtgcagactctaattagaacttttaacattttgaataaattcttagttgttggttttctgttataa

SEQ ID NO: 119711 - DNA, 1912 bp, Homo sapiens
  Payload ID: 3476
  Gene Symbol: CFAP52
  Gene Name: cilia and flagella associated protein 52
  Uniprot ID: Q8N1V2
  ENST ID: ENST00000396219
  CDS Start-End: 70-1728
gttaccataacgaccagaagacgctgcagccactagggaggagagcaaagtaatcagaacctcccaaggatggataacaaaatttcgccggaggcccaagtggcggagctggaacttgacgccgtgatcggcttcaatgacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttc

SEQ ID NO: 119712 - DNA, 2266 bp, Homo sapiens
  Payload ID: 3476
  Gene Symbol: CFAP52
  Gene Name: cilia and flagella associated protein 52
  ENST ID: ENST00000576630
  CDS Start-End: 27-155
agcaaagtaatcagaacctcccaaggatggataacaaaatttcgccggaggcccaagtggcggagctggaacttgacgccgtgatcggcttcaatggtcctgttctcctgaaactgtttttagtgaataaactaccaactcaagcaaaacaataattacattcaagcatacaaacttttctctaacatggaagcagtagtgttaccttggcagatatttggagtacgggagttgcctgtggaaagaggtgtcaccatgaaaggtcccaggctcttcagagcacctggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagaagattcagttacaaggcggcatcacttctatcacacttcgaggagaaggacaccagtttctcgtaggaacagaagaatcgcacatttatcgtgtcagcttcacggatttcaaagagacgctcatagcgacttgtcactttgatgctgtcgaggatattgtctttccatttggcactgctgagctatttgcaacctgtgccaagaaggatatcagggtgtggcacacatcatccaacagggagctgctgcggatcaccgtgcccaacatgacctgccacggcatcgacttcatgagggacggcaaaagcatcatttcagcatggaacgacggtaaaatccgagccttcgccccagagacaggccgactgatgtatgtcattaacaatgctcacaggatcggcgtcaccgccatcgccaccaccagtgactgtaaaagggtcatcagtggcggtggggaaggggaggtgagggtatggcagataggctgtcagacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaagattgcttactgggaagtatttgatgggacagtaatcagagaattggaaggttccctgtctgggtcgataaatggcatggatatcacacaggaaggggtgcactttgtcacaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaag

SEQ ID NO: 119713 - DNA, 579 bp, Homo sapiens
  Payload ID: 3476
  Gene Symbol: CFAP52
  Gene Name: cilia and flagella associated protein 52
  ENST ID: ENST00000572333
  CDS Start-End: 27-122
agcaaagtaatcagaacctcccaaggatggataacaaaatttcgccggaggcccaagtggcggagctggaacttgacgccgtgatcggcttcaatggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttg

SEQ ID NO: 119714 - DNA, 541 bp, Homo sapiens
  Payload ID: 3476
  Gene Symbol: CFAP52
  Gene Name: cilia and flagella associated protein 52
  ENST ID: ENST00000574937
  CDS Start-End: 53-199
aagacgctgcagccactagggaggagagcaaagtaatcagaacctcccaaggatggataacaaaatttcgccggaggcccaagtggcggagctggaacttgacgccgtgatcggcttcaatgtgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggactaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaatgtgtgtacattcccattatgatgaagataaactcaaagtaattatcaccaggaagattcagttacaaggcggcatcacttctatcacacttcgaggagaa

SEQ ID NO: 119715 - DNA, 581 bp, Homo sapiens
  Payload ID: 3476
  Gene Symbol: CFAP52
  Gene Name: cilia and flagella associated protein 52
  ENST ID: ENST00000575247
  CDS Start-End: 55-150
agaagacgctgcagccactagggaggagagcaaagtaatcagaacctcccaaggatggataacaaaatttcgccggaggcccaagtggcggagctggaacttgacgccgtgatcggcttcaatggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaaaaagaaaagaaggccaggcgttgtagcttatgcctgtaatcccagcactttgggaggctgaagcggatggatcacgaggtcaagagatggagaccatcctggccaacatgtgggacaattcgagtatgggaattggatcttccaaatagaaaaatctggccaactgagtgccaaacaggacagttgaaaag

SEQ ID NO: 119716 - DNA, 597 bp, Homo sapiens
  Payload ID: 3476
  Gene Symbol: CFAP52
  Gene Name: cilia and flagella associated protein 52
  ENST ID: ENST00000574097
  CDS Start-End: 1-280
gacccagaagctggaggaggccctgaaggaacacaagtcatcagtgtcctgcattagggtgaagaggaacaacgaggagtgtgtcaccgccagcaccgatgggacttgtatcatttgggaccttgtgcgtctcaggaggaatcagatgatactagccaacaccttattccagtgtgtgtgctatcaccctgaggagttccagatcatcaccagcggaacagacagaaaggtggaaatgaccatctggtcaaagtttgggattataatgagggtgaagtgactcacgttggggtgggacacagtggcaacatcacacgcatccgcataagtccaggaaatcaatatattgttagtgtaagtgccgatggagccattttgcgatggaagtacccatatacctcctgaagctgatgagatgtctctgagccttggcgttgcacgcagtcctgttgaagactgagtttagataactccaacactagtcttcatttctcacagctctgtttttgttcttgagtcaatttttctctttttctttatagaatgcattttatattcttaaattgcatattaaaattgaagtatgttcaagaataa

SEQ ID NO: 119717 - DNA, 711 bp, Homo sapiens
  Payload ID: 3476
  Gene Symbol: CFAP52
  Gene Name: cilia and flagella associated protein 52
  ENST ID: ENST00000576499
  CDS Start-End: 15-398
agaacctcccaaggatggataacaaaatttcgccggaggcccaagtggcggagctggaacttgacgccgtgatcggcttcaatggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaagtatgtgtctgcgttcggagttttcagaactcataaattgctatattttcttgcacagaaaacatggtcattctgatctgggggaacacgtctttagtcctggataaataccttacatcatagtttttgtgattttgtactcattaaaagttctcttcactggaa

SEQ ID NO: 119718 - DNA, 1851 bp, Homo sapiens
  Payload ID: 3477
  Gene Symbol: CFAP53
  Gene Name: cilia and flagella associated protein 53
  Uniprot ID: Q96M91
  ENST ID: ENST00000398545
  CDS Start-End: 119-1663
aatcccgcgaggcgcaccatggcaaccagacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaa

SEQ ID NO: 119719 - DNA, 4244 bp, Homo sapiens
  Payload ID: 3478
  Gene Symbol: CFAP57
  Gene Name: cilia and flagella associated protein 57
  Uniprot ID: Q96MR6
  ENST ID: ENST00000372492
  CDS Start-End: 325-4077
aagaaacggggtatcccgagacccaagcggctagcagagggcggccctggccgctgctgcctgccttcagccccctactcccacgccgtggctccacgtgccaccgaatcgctccagcgccagcaactcacagctactgctcaacttttgattgggacttccgcttccggcggcaaaccatacttccggtttgtcgttgctataggaaccgctacggcgtttgaaagtgtccgggttgcttaggatccctacaggtagcgcctctggatacatgcgtggtctgctgacccagagagaaacgaaagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcgcattctggacgcatgatgtttgtgggcacctcggtgggaaccattcgtgccatgaagtaccctctgcctctgcagaaggaattcaatgagtaccaggcccatgccggtcctatcaccaagatgttgcttacctttgatgatcagttcctgctgactgctgctgaggatggctgcctgttcacctggaaggtctttgataaggatggccggggaatcaagcgagagagggaggtgggctttgccgaagaggtgcttgtgactaaaacagacatggaagaaaaggctcaggttatgttggagctaaagactcgtgtggaggaattaaaaatggagaatgagtatcaactccgactaaaggacatgaactattctgagaagattaaggagctaacagacaagttcatccaggaaatggagtccttgaaaacaaaaaaccaggtcttaagaacagaaaaagagaagcaggatgtttatcaccatgagcacatagaagacctcctagacaagcaaagccgggaactgcaggacatggaatgttgcaacaaccaaaagttgcttctagaatatgagaagtaccaggagctgcagctcaagtcccagaggatgcaggaagagtatgaaaaacagctccgggataacgatgagaccaagagccaggccctggaggagctgactgagttttacgaggcaaaactgcaggagaaaaccacccttctggaagaggcacaggaagacgtcaggcagcagctgcgggagtttgaagagaccaagaagcagattgaggaagatgaagaccgagaaatccaagatatcaaaaccaagtatgagaaaaagcttcgggatgaaaaggaatcaaacctgcggctcaagggagaaacaggcatcatgaggaagaagttcagcagcctacagaaggagattgaagaacgaaccaatgacatcgagaccctaaaaggagagcagatgaagctgcaaggagtcattaagtctctggagaaggacatccaaggcctcaagcgagagatccaggaaagagacgagactattcaagacaaggagaagcgaatttatgatctgaaaaagaaaaatcaagaactagggaaattcaagtttgtgcttgactacaaaataaaggagctgaagaagcaaatagaacctcgagagaatgagatcagggtgatgaaggaacagattcaggagatggaagctgaactggagaatttccataagcagaacactcaactggagctgaacatcacagaattgtggcagaaactgagagccaccgatcaggagatgcgcagagagagacagaaggagcgagacttggaagcgctggtcaaaaggtttaaaacagacctccacaactgcgtagcctatattcaggaaccgcggctgctgaaggagaaggttcgaggtctctttgagaagtacgtgcagcgagcagacatggtggagatcgcagggctgaacacagacctgcagcaggagtacacccggcagcgggagcacctggagaggaacctggccactctcaagaagaaggtggtcaaggagggcgagctgcaccgcacagactacgtccgcatcatgcaggaaaatgtctctctgatcaaggaaattaatgagctccgcagggagctgaagttcactcggtcccaagtctatgaccttgaagcagctctgaaactgaccaagaaagtccgaccacaagaagtttcagagacagaacccagcagggacatgctcagcacagctcccaccgcaaggttgaatgagcaagaagaaactgggaggatcattgaaatgcagcgcctagaaatccagcgcctcagagaccagatccaagagcaagagcaggtcacagggttccacaccctcgctggagttcggcttccttccctctccaactccgaggtagacttagaggtgaagaccaactgaccccctctggtgagccatctccagccacagccagaagaaacacagcatgtctgtccccaagccagacttgcggttggagtctgtatggtccctgcagcactgaccccagcaacctctttctcttgccctggggaatttgggacacagaataaaggtgtttgcccaca

SEQ ID NO: 119720 - DNA, 579 bp, Homo sapiens
  Payload ID: 3478
  Gene Symbol: CFAP57
  Gene Name: cilia and flagella associated protein 57
  ENST ID: ENST00000428122
  CDS Start-End: 1-235
agagagggaggtgggctttgccgaagaggtgcttgtgactaaaacagacatggaagaaaaggctcaggttatgttggagctaaagactcgtgtggaggaattaaaaatggagaatgagtatcaactccgactaaaggacatgaactattctgagaagattaaggagctaacagacaagttcatccaggaaatggagtccttgaaaacaaaaaaccaggtctgtttaagagactgaccaacaagcacaaataacaagaaatttccactttcaagacaggactggcatatactgcccaagctatgctcaaacagtcttaagaacagaaaaagagaagcaggatgtttatcaccatgagcacatagaagacctcctagacaagcaaagccgggaactgcaggacatggaatgttgcaacaaccaaaagttgcttctagaatatgagaagtaccaggagctgcagctcaagtcccagaggatgcaggaagagtatgaaaaacagctccgggataacgatgagaccaagagccaggccctggaggagctgactgagttttacgaggcaaaactgcaggagaaaa

SEQ ID NO: 119721 - DNA, 2094 bp, Homo sapiens
  Payload ID: 3478
  Gene Symbol: CFAP57
  Gene Name: cilia and flagella associated protein 57
  ENST ID: ENST00000533339
  CDS Start-End: 52-243
gcgtggtctgctgacccagagagaaacgaaagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggttcattctggctgctgtacagaggacagatttaaggaggagaaagaaaggaagcagggagaacagctgagggatgattgctgtaattcaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcgcattctggacgcatgatgtttgtgggcacctcggtgggaaccattcgtgccatgaagtaccctctgcctctgcagaaggaattcaatgagtaccaggcccatgccggtcctatcaccaaggaatttagcctaggaaatcatca

SEQ ID NO: 119722 - DNA, 576 bp, Homo sapiens
  Payload ID: 3478
  Gene Symbol: CFAP57
  Gene Name: cilia and flagella associated protein 57
  ENST ID: ENST00000529956
  CDS Start-End: 79-576
gttgctataggaaccgctacggcgtttgaaagtgtccgggttgcttaggatccctacagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataac

SEQ ID NO: 119723 - DNA, 456 bp, Homo sapiens
  Payload ID: 3478
  Gene Symbol: CFAP57
  Gene Name: cilia and flagella associated protein 57
  ENST ID: ENST00000525227
  CDS Start-End: 63-254
ggatacatgcgtggtctgctgacccagagagaaacgaaagcagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggttcattctggctgctgtacagaggacagatttaaggaggagaaagaaaggaagcagggagaacagctgagggatgattgctgtaattcaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaat

SEQ ID NO: 119724 - DNA, 3037 bp, Homo sapiens
  Payload ID: 3478
  Gene Symbol: CFAP57
  Gene Name: cilia and flagella associated protein 57
  Uniprot ID: Q96MR6
  ENST ID: ENST00000528956
  CDS Start-End: 147-2243
acttccggtttgtcgttgctataggaaccgctacggcgtttgaaagtgtccgggttgcttaggatccctacaggtagcgcctctggatacatgcgtggtctgctgacccagagagaaacgaaagcagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcgcattctggacgcatgatgtttgtgggcacctcggtgggaaccattcgtgccatgaagtaccctctgcctctgcagaaggaattcaatgagtaccaggcccatgccggtcctatcaccaaggtgagcagggccctctccccaggaacccagtcccacacctgcctgctacgtgccttgttcatcccttcaacctcccaatgtcttttctctctccttcttctctcttatttattcatccatcattcattgaatcaccatctattgactatgaatatactctttgtttaaactacttccaggaatttagcctaggaaatcatcagagatacacctaaaaatgtatgtacaacgttttcaccataatattatgcataataaggggccgtttggtggatgccgtagctgccgtgagtgtgggctgcacttgaccacagctgcctcctcctccagagaatgccccagactgaaaggagccatagccctgaagattggcccctacctctccctgagggtacaaaaggccaccccaggggcaataccatgagtacacatttgtaaattgtccttccattcacccttctcataaagtagtatctatgttcaacagtcaaaatgtggaagcaaccaagcatccatcgacagacgaatgcataagcaaaagatggtatatctatacaatggaacaataccctgcctaaaaaggaagggaattctgcaatgtgctaccacatggatgaaccttgaggatgttatgctaaattaaataaggccaaccacaaaaagataagtacagtgtgattccacttttaggagatacttggagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgc

SEQ ID NO: 119725 - DNA, 4162 bp, Homo sapiens
  Payload ID: 3478
  Gene Symbol: CFAP57
  Gene Name: cilia and flagella associated protein 57
  ENST ID: ENST00000610710
  CDS Start-End: 147-3998
acttccggtttgtcgttgctataggaaccgctacggcgtttgaaagtgtccgggttgcttaggatccctacaggtagcgcctctggatacatgcgtggtctgctgacccagagagaaacgaaagcagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcgcattctggacgcatgatgtttgtgggcacctcggtgggaaccattcgtgccatgaagtaccctctgcctctgcagaaggaattcaatgagtaccaggcccatgccggtcctatcaccaagatgttgcttacctttgatgatcagttcctgctgactgctgctgaggatggctgcctgttcacctggaaggtctttgataaggatggccggggaatcaagcgagagagggaggtgggctttgccgaagaggtgcttgtgactaaaacagacatggaagaaaaggctcaggttatgttggagctaaagactcgtgtggaggaattaaaaatggagaatgagtatcaactccgactaaaggacatgaactattctgagaagattaaggagctaacagacaagttcatccaggaaatggagtccttgaaaacaaaaaaccaggtcttaagaacagaaaaagagaagcaggatgtttatcaccatgagcacatagaagacctcctagacaagcaaagccgggaactgcaggacatggaatgttgcaacaaccaaaagttgcttctagaatatgagaagtaccaggagctgcagctcaagtcccagaggatgcaggaagagtatgaaaaacagctccgggataacgatgagaccaagagccaggccctggaggagctgactgagttttacgaggcaaaactgcaggagaaaaccacccttctggaagaggcacaggaagacgtcaggcagcagctgcgggagtttgaagagaccaagaagcagattgaggaagatgaagaccgagaaatccaagatatcaaaaccaagtatgagaaaaagcttcgggatgaaaaggaatcaaacctgcggctcaagggagaaacaggcatcatgaggaagaagttcagcagcctacagaaggagattgaagaacgaaccaatgacatcgagaccctaaaaggagagcagatgaagctgcaaggagtcattaagtctctggagaaggacatccaaggcctcaagcgagagatccaggaaagagacgagactattcaagacaaggagaagcgaatttatgatctgaaaaagaaaaatcaagaactagggaaattcaagtttgtgcttgactacaaaataaaggagctgaagaagcaaatagaacctcgagagaatgagatcagggtgatgaaggaacagattcaggagaatgaccccattctaaagtggccccagagggtcgagattcacttatacaacttcagaaagcaggtgaggaaggtgcttctctggggaaccctgcctcagatggaagctgaactggagaatttccataagcagaacactcaactggagctgaacatcacagaattgtggcagaaactgagagccaccgatcaggagatgcgcagagagagacagaaggagcgagacttggaagcgctggtcaaaaggtttaaaacagacctccacaactgcgtagcctatattcaggaaccgcggctgctgaaggagaaggttcgaggtctctttgagaagtacgtgcagcgagcagacatggtggagatcgcagggctgaacacagacctgcagcaggagtacacccggcagcgggagcacctggagaggaacctggccactctcaagaagaaggtggtcaaggagggcgagctgcaccgcacagactacgtccgcatcatgcaggaaaatgtctctctgatcaaggaaattaatgagctccgcagggagctgaagttcactcggtcccaagtctatgaccttgaagcagctctgaaactgaccaagaaagtccgaccacaagaagtttcagagacagaacccagcagggacatgctcagcacagctcccaccgcaaggttgaatgagcaagaagaaactgggaggatcattgaaatgcagcgcctagaaatccagcgcctcagagaccagatccaagagcaagagcaggtcacagggttccacaccctcgctggagttcggcttccttccctctccaactccgaggtagacttagaggtgaagaccaactgaccccctctggtgagccatctccagccacagccagaagaaacacagcatgtctgtccccaagccagacttgcggttggagtctgtatggtccctgcagcactgaccccagcaacctctttctcttgccctggggaatttgggacacagaataaaggtgtttgccc

SEQ ID NO: 119726 - DNA, 466 bp, Homo sapiens
  Payload ID: 3479
  Gene Symbol: CFAP58
  Gene Name: cilia and flagella associated protein 58
  ENST ID: ENST00000369703
  CDS Start-End: 1-279
atggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggctgactctgtcaggatgccctggcctctggacaaagggaaatggtgaaacagtggaccctcagggagcttctgagcctctgctgacaagggaagggcacagatcctacccactcatattccaccggccaaccaagtcacagggctgtgccggacatcctgggcaggagtgtggtcctccttagggaggggccctgtagggtgaggcagcaaatatatttgaacataaaatgtca

SEQ ID NO: 119727 - DNA, 3313 bp, Homo sapiens
  Payload ID: 3479
  Gene Symbol: CFAP58
  Gene Name: cilia and flagella associated protein 58
  Uniprot ID: Q5T655
  ENST ID: ENST00000369704
  CDS Start-End: 135-2753
gcgccgagcgcgggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagaccactgaacagcagcaggaaacagagcgatcaaaagaggaggctgaacatgccatcagtcagttccaacaagaaatccagcaacgtcagaacgaagcttcccgggagttccggaagaaggaaaaactagagaaagagctcaagcagattcaggcagacatggacagcaggcagacagaaataaaagccctgcagcagtatgtgcagaagagcaaggaggagcttcagaagctggagcagcagctgaaggagcagaagatattgaatgagagagctgcaaaggaactcgagcaatttcagatgagaaatgctaaacttcagcaagagaatgaacagcacagtttggtctgtgagcagctatcccaggaaaaccaacagaaggcgttggagctcaaagccaaagaggaagaagtccatcaaatgcgccttgacatcgggaagctcaacaaaatcagagaacaaattcataagaaattgcaccacaccgaagatcaaaaggcagaagtcgaacagcacaaagaaaccctaaaaaatcagattgtgggattagagagagaggtagaggcttcaaagaaacaagcagaacttgacagaaaggcaatggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggtccttatgaacatggaagacataaaagttcgtgaaacacagatttttgactacaggaaaaaaatagctgaatcagagattaaattaaaacagcaacagaacctatatgaagctgtgagatcagacagaaatctgtatagcaaaaatctggttgaggctcaggatgaaataacagatatgaagagaaagttaaagattatgatccatcaggtagatgagctgaaagaagacatctctgccaaagagtccgcacttgtgaagctgcacctggaacagcagcgaatagaaaaggaaaaggaaacattgaaggctgagctgcagaagctgagacaacaagccctggagacaaaacactttattgaaaagcaagaagctgaagagagaaaactcctgcgaataattgctgaggctgacggggagaggttgagacagaagaaggaattagaccaggtcatcagtgagagagatatcctggggtctcagcttgttcggcgcaatgatgagttagctttgctctatgagaagatcaagatccaacagtctgtgctgaataaaggggagagccagtacaaccagaggttggaggacatgagaatcctcagacttgagatcaagaagcttcgccgggaaaaggggattcttgccaggagtatggctaatgttgaagaactcagacaggagttttttcacatgcaaagagaattgttgaaggagaggacacgctgccgagccctggaggaggagctggagaatcccctgaatgtgcacagatggaggaagctcgaggccagcgaccccaatgcatatgagctgatacagaaaattcacaccctgcagaagcgtctcatcagcaagactgaagaggtggttgaaaaagagctgctcctccaggaaaaggagaaactctacatggaactaaagcacgtcttggcccgccagcctggacctgaggctgcggaacagctgaagctgtaccgacgcacgctgcatgacaagaagcagcagctgaaagttttgtcttcagaattgaatatgtatgaagtacagagcaaagaatataaatatgaggtagagaaacttaccaatgagctccagaatttaaagaagaaatacctcgctcagaaacgtaaagaacaacttcaaaaaaacaaggacacagcacccatggataacaccttcttaatggtcaaaccaaatggtcctggttttactgggggcggatttcctctcaggtcaaccaaaatgacgttctaacctgaagctgctggctgtttccagttgaacaactcatgaaatctgctctgggacattttgggggaatctcaaagtccttggatcatagaactgagtgctgagaatccaggatggaaagaaatgcagaactatcatagtcacatacatataagagggatggtgttttgtctggttcacgttgatattaacagatcataattctctctgttcagttaggctgacctattgcatgaagcaaatcttttgttgctaccccattgattgaaatgtactagaccttaatttctttattacagacattggtgtacttgaaggttttatatttaaaagtatttttgaaatgcaatgtgtcccctctcaccttattaacaataatctattttaattattcctcattaacaagtcattgcatgagatgagaaagaaggacaaactcttaagaatttaaaaagtgttttgagaatgatttctatatggaatttcttttcaggcccggaatgggaaaatctattccaaagagacacactaataaatacttcattataaaaaataaaaaagaa

SEQ ID NO: 119728 - DNA, 4082 bp, Homo sapiens
  Payload ID: 3480
  Gene Symbol: CFAP61
  Gene Name: cilia and flagella associated protein 61
  Uniprot ID: Q8NHU2
  ENST ID: ENST00000245957
  CDS Start-End: 77-3790
ggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgatggaacactgctgcaggcatttgtagctgaagttgcagaacaaatagttggtattgcagtgatcagaaatgaaatggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaagggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 119729 - DNA, 1185 bp, Homo sapiens
  Payload ID: 3480
  Gene Symbol: CFAP61
  Gene Name: cilia and flagella associated protein 61
  ENST ID: ENST00000340348
  CDS Start-End: 74-1185
accgtttccatggtgaccaggctgcgcgtcctccttgcggcagcgcgtggagtgcggcgtcctggagctgcggatgagagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgtaag

SEQ ID NO: 119730 - DNA, 1059 bp, Homo sapiens
  Payload ID: 3480
  Gene Symbol: CFAP61
  Gene Name: cilia and flagella associated protein 61
  Uniprot ID: Q8NHU2
  ENST ID: ENST00000377293
  CDS Start-End: 70-672
tgcgtataatgcacatgactctcttgaagtgatgacaatgaacagccatggccaagcacccatgcacagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaa

SEQ ID NO: 119731 - DNA, 679 bp, Homo sapiens
  Payload ID: 3480
  Gene Symbol: CFAP61
  Gene Name: cilia and flagella associated protein 61
  ENST ID: ENST00000377303
  CDS Start-End: 113-679
gcgtggagtgcggcgtcctggagctgcggatgaggtgggtaacgccgtgctgactagcagcgacgcaaggactgcggtgcagggcgtccagggcgcatccccaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagg

SEQ ID NO: 119732 - DNA, 2017 bp, Homo sapiens
  Payload ID: 3480
  Gene Symbol: CFAP61
  Gene Name: cilia and flagella associated protein 61
  Uniprot ID: Q8NHU2
  ENST ID: ENST00000377306
  CDS Start-End: 77-1489
ggcagcgcgtggagtgcggcgtcctggagctgcggatgagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaaaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttttga

SEQ ID NO: 119733 - DNA, 1871 bp, Homo sapiens
  Payload ID: 3480
  Gene Symbol: CFAP61
  Gene Name: cilia and flagella associated protein 61
  Uniprot ID: Q8NHU2
  ENST ID: ENST00000377308
  CDS Start-End: 130-1092
ttagaaaggtgatgtgtgaggcccggcagctgttggtgttacagctattgtgtgggaaacaaaagccattctgttctgttccccagcctgcctttgtatcacggatagaggagctgtttcataaatgagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaa

SEQ ID NO: 119734 - DNA, 776 bp, Homo sapiens
  Payload ID: 3480
  Gene Symbol: CFAP61
  Gene Name: cilia and flagella associated protein 61
  Uniprot ID: Q8NHU2
  ENST ID: ENST00000389656
  CDS Start-End: 4-606
cagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtctt

SEQ ID NO: 119735 - DNA, 750 bp, Homo sapiens
  Payload ID: 3480
  Gene Symbol: CFAP61
  Gene Name: cilia and flagella associated protein 61
  ENST ID: ENST00000431753
  CDS Start-End: 1-683
agaacttcgtgaaaatggtccctttcaacacctgcaccctcgagcaggacctctacgtcttccaccgggctggattgctcaagtccattaatataagatttgccactctcttggatactcctggtgtggaaaatcttgtcagcaccctcatgttgaataaaagcatattggaggacttagaccgttacaacaaggctcgcaaagaccctgacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaagttccagaacccctacgcccactccctgacatctgcccttcattacttggttcccgtgcgaccacgacgacagattgtctatcctctggaaaagcttggcataaacgctccatcaaaggcggtctccaaggatccgatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaa

SEQ ID NO: 119736 - DNA, 559 bp, Homo sapiens
  Payload ID: 3480
  Gene Symbol: CFAP61
  Gene Name: cilia and flagella associated protein 61
  ENST ID: ENST00000442372
  CDS Start-End: 100-303
ggcttaagagagagcctcttcagaactccaagatttggatgtttttctatttttcccagaagaattcgtgttgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagagacaaggtctcattttgttgcccaggctggggtacagtggtgcaagtatggctcactgcagccttgaactctttctgggctcaagtgatcctcctacttcagcttcctgagtagctggactatagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggagtcgctggattttatgaattttgttttcagtc

SEQ ID NO: 119737 - DNA, 1946 bp, Homo sapiens
  Payload ID: 3480
  Gene Symbol: CFAP61
  Gene Name: cilia and flagella associated protein 61
  Uniprot ID: Q8NHU2
  ENST ID: ENST00000451767
  CDS Start-End: 9-1421
gataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaagatgctgagctcaggagtagcagccaaggttcccaaaaaatagtcgaggagttgcaggaacctgtctctccagataccatggaaaacatccagggaaatattgccagagaagctgcatccgaggaagctttaacagcagtccaaagtggaaatgttagtgaaccggaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggtcgctggattttatgaattttgttttcagtcttttttctgataagaacttctgtgtaatttctctgccccatctcacccccgagttcttcctcatccagaacttcgtgaaaatggtccctttcaacacctgcaccctcgagcaggacctctacgtcttccaccgggctggattgctcaaaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttt

SEQ ID NO: 119738 - DNA, 569 bp, Homo sapiens
  Payload ID: 3480
  Gene Symbol: CFAP61
  Gene Name: cilia and flagella associated protein 61
  ENST ID: ENST00000475466
  CDS Start-End: 163-569
agctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcgaaccgtgtataaggcagtgccagagctgcacttcat

SEQ ID NO: 119739 - DNA, 570 bp, Homo sapiens
  Payload ID: 3480
  Gene Symbol: CFAP61
  Gene Name: cilia and flagella associated protein 61
  ENST ID: ENST00000494029
  CDS Start-End: 43-210
gcgtggagtgcggcgtcctggagctgcggatgaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctattttctcgttcttgtctgcactgacagtgtattccttctgtgataaaaacataactggaaagcccatgtcactttctgtcctcctgtcatctcctctccgcctcttcctccagttacatgcttgcttcttcctgttctcctcaagaaggaacatggagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacacccctgaatacgttgttcatgcacctctttgtggccgtggatgagtattctgttggctgttgcaaagagattcttcg

SEQ ID NO: 119740 - DNA, 542 bp, Homo sapiens
  Payload ID: 3480
  Gene Symbol: CFAP61
  Gene Name: cilia and flagella associated protein 61
  ENST ID: ENST00000472660
  CDS Start-End: 61-542
gaatagagcagcagctgctgactcaagagcgccgggaaaaggcccctgaatacgttgttcatgcacctctttgtggccgtggatgagtattctgttggctgttgcaaagagattcttcgaaccgtgtataaggcagtgccagagctgcacttcatatttctcatcgtgccatcctacatgagcctaggctcaactctcataactgtttttgaccaagtggggaacatcccgtgtctgacgtatgaggaagactttgcagtgcatatatgtcacaggcacagccactatcctcagctgcacgttcgcaaagccagggtggaagaccatgacgatctcatgccaatatttatgcgctatgacacaattctgaaggaaacttacggtgaatacttcctggccgaactaatagaggcccaagatgaagagaatcatgctgttgtgtgtgaggtggaaggcacagctgttgggttcatgagtgtgtgctcaagagtgaacatgcaactgctgcatgagtgctttgacttgggccctttccacggact

SEQ ID NO: 119741 - DNA, 3902 bp, Homo sapiens
  Payload ID: 3481
  Gene Symbol: CFAP69
  Gene Name: cilia and flagella associated protein 69
  Uniprot ID: A5D8W1
  ENST ID: ENST00000389297
  CDS Start-End: 252-3077
agcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaa

SEQ ID NO: 119742 - DNA, 1489 bp, Homo sapiens
  Payload ID: 3481
  Gene Symbol: CFAP69
  Gene Name: cilia and flagella associated protein 69
  ENST ID: ENST00000449577
  CDS Start-End: 1-1437
gaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaa

SEQ ID NO: 119743 - DNA, 1545 bp, Homo sapiens
  Payload ID: 3481
  Gene Symbol: CFAP69
  Gene Name: cilia and flagella associated protein 69
  ENST ID: ENST00000457170
  CDS Start-End: 1-1545
gatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcaaaggatcagacagctgctagtcttttaattaaattgtgg

SEQ ID NO: 119744 - DNA, 526 bp, Homo sapiens
  Payload ID: 3481
  Gene Symbol: CFAP69
  Gene Name: cilia and flagella associated protein 69
  ENST ID: ENST00000418199
  CDS Start-End: 1-269
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagacttta

SEQ ID NO: 119745 - DNA, 2299 bp, Homo sapiens
  Payload ID: 3481
  Gene Symbol: CFAP69
  Gene Name: cilia and flagella associated protein 69
  ENST ID: ENST00000427396
  CDS Start-End: 231-590
aacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattgg

SEQ ID NO: 119746 - DNA, 2614 bp, Homo sapiens
  Payload ID: 3481
  Gene Symbol: CFAP69
  Gene Name: cilia and flagella associated protein 69
  Uniprot ID: A5D8W1
  ENST ID: ENST00000451029
  CDS Start-End: 215-904
tcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgggctttgaaggaagtatttaaaaatctgtttatgagaggtttcagtcattatgaccgtcagcttagaaatgacatattagtgatcactacaattatagctcaaaatcctgaagcaccaatgattgagaatttctctcggagctactactcatctgtaccagaagctgagccttcacatattttataattaaaaatcattgaatgattgaaattatttaatagagatccttggcaacaatattcacaagtcagtcacgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaagctccatagtgaactctgagtctcagagattgataatttaaatgttaaatagcaagggatggaattggaaagataaaaacaaaaaaatgatggtttcaatagatagattttaagtgaacgcctgtttagctccaagctttgatgcaatttctcatcatattctaccaccctgtgcctgggctcctctggaaaaataatcataatcttgcttactgggaaccagaactgaacagcaaggcaataagaaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaa

SEQ ID NO: 119747 - DNA, 611 bp, Homo sapiens
  Payload ID: 3481
  Gene Symbol: CFAP69
  Gene Name: cilia and flagella associated protein 69
  ENST ID: ENST00000445156
  CDS Start-End: 1-280
tgaacaaaaagtatatgcaaaaatacaggccacgcacaagcaaagagagctggctaataaatcatgggaagatttcttggctagaacatcaaacgctaaaacgttaaaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacc

SEQ ID NO: 119748 - DNA, 573 bp, Homo sapiens
  Payload ID: 3481
  Gene Symbol: CFAP69
  Gene Name: cilia and flagella associated protein 69
  ENST ID: ENST00000412839
  CDS Start-End: 1-511
cccatctattgcggttatggatgtttctgagaatattagagcaaaaatttatgctatattgggcaaactagattttgaaaatttacctggcctatctgctgaagattttgtcaccctttgtatcatacatagatatcttgattttaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatcttta

SEQ ID NO: 119749 - DNA, 3032 bp, Homo sapiens
  Payload ID: 3481
  Gene Symbol: CFAP69
  Gene Name: cilia and flagella associated protein 69
  Uniprot ID: A5D8W1
  ENST ID: ENST00000497910
  CDS Start-End: 211-2982
aggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtggcttgccatttttgaaaaagaaagtgtcggatgaaataacttatgctgaagatactgctaattcaattgcacttctgggtgacttaatgaaaataccaagttctgaattgaggatacaaatttgttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctg

SEQ ID NO: 119750 - DNA, 3703 bp, Homo sapiens
  Payload ID: 3482
  Gene Symbol: CFAP70
  Gene Name: cilia and flagella associated protein 70
  Uniprot ID: Q5T0N1
  ENST ID: ENST00000310715
  CDS Start-End: 122-3487
agctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaaggcaatgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaattc

SEQ ID NO: 119751 - DNA, 1403 bp, Homo sapiens
  Payload ID: 3482
  Gene Symbol: CFAP70
  Gene Name: cilia and flagella associated protein 70
  ENST ID: ENST00000340329
  CDS Start-End: 105-1190
agtaagttctcgcgagaggtagttggttgctatagttgtcaaaaacataactgaggctgctgcagagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaatggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 119752 - DNA, 3691 bp, Homo sapiens
  Payload ID: 3482
  Gene Symbol: CFAP70
  Gene Name: cilia and flagella associated protein 70
  ENST ID: ENST00000355577
  CDS Start-End: 1706-3478
agcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggcccaaaaagtggccaattgccaacattctggctccaggagctaataacattcctgatgcattcattgttggtggtccctatgaagaagaagaaggagaactcaaccatcctgaggacagcgaatttaggaatcaagcagagtgcataaagaaaaggattatttgggacttggaaagtcgctgctaccttgatccttctgcagtggtcagttttcagaagcgaattgccgattgccggctttggcctgtagagatcacaagagttcctctggtcactatacccaaagggaaagctggcaaaactgaaaagactgatgaagaagctcagctttcgtttcatggtgtggcttatgttaatatggtcccattgttgtatccaggtgtgaagagaattcggggagcttttcatgtttacccttacctagacagtgtagtccatgaaaagaccaaatgtttattgagcttgttccgggatattggccatcacttgattcataataataaaataggaggaattaattctctgctgtccaaacaagctgtttctaagaatctgaaagaagataaaccagtgaaagaaaaggatatagatggaaggcctaggcctggggatgtgcaggcacctagtataaaatctcagagctcagatactcctttggaaggtgaaccccctctaagtcacaatcctgaaggacagcaatatgtagaagcagggacatacattgtgttggaaattcagctggacaaagccttggttccaaagcgaatgccagaggagctagccagaagggtcaaggaaatgattcctccaaggcctcctcttacccgtcggacaggaggagctcagaagtgagtgactaccacatacagatcaagaatatttctagagccattctagatgaatactacagaatgtttggaaaacaggtggccaaactggagagtgatatggatagtgaaaccttggaggagcagaagtgccagctcagctatgaacttaattgctctggaaaatactttgctttcaaagaacaactcaagcatgctgtggtaaagattgtgagagataaatacttgaagacaacatcatttgaaagccaggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagtatgaaaaggcaaagaaaacctatatgcaagcctgtaagagatcaccttcatgccttacctggctaggactgggaatcgcctgctatcggctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 119753 - DNA, 1222 bp, Homo sapiens
  Payload ID: 3482
  Gene Symbol: CFAP70
  Gene Name: cilia and flagella associated protein 70
  ENST ID: ENST00000394865
  CDS Start-End: 474-1013
tggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcaggtcagagttgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactc

SEQ ID NO: 119754 - DNA, 1710 bp, Homo sapiens
  Payload ID: 3482
  Gene Symbol: CFAP70
  Gene Name: cilia and flagella associated protein 70
  ENST ID: ENST00000433268
  CDS Start-End: 1-1497
caggaggaacttcagacatttatcagtgagctctatgtgttcttagtagatcagatgcatgtagccctaaaccagaccatgccagatgatgtccaaggcactgttgcaaccatttatacaagcagtgaacagcttcaactctttgcatttgaagcagaagtcaatgagaactttgagatggcagcagcatattataaagagagattggtccgtgagccccagaatctggatcactggttggactatggtgccttctgcctcctaactgaagacaacatcaaagcacaagagtgttttcagaaagccctttccctcaaccagagtcatatccacagcttgttgctgtgtggtgtcctggctgtcctgttggagaactatgagcaagcagaaattttctttgaggatgctacttgcttggaaccaactaatgttgtagcctggactttacttggtttgtactatgaaattcaaaacaatgatattcgaatggaaatggcatttcatgaggcctccaaacagcttcaggcacggatgcttcaggcacaagtaacaaagcaaaagagcactggtgtagaagacactgaggaaagagggaagagagaatctagtttaggcccttggggaatcacaaatggttctgcaacagcaatcaaggtggaagccccagcaggaccaggagctgcattatctattctagacaaatttcttgaagaatcctccaaactgcagtctgattcacaagaacccattttgactacacaaacttgggatccaagtataagccaaaaaccatctaacacatttatcaaggagataccaacaaagaaagaagcatcaaaatgtcaagattcatcagctcttctgcatcccggccttcattatggtgtttctcaaactaccaccatcttcatggagaccatacatttcttgatgaaagtcaaggctgtgcagtatgtgcacagagtgcttgcacatgagctgttatgccctcaaggaggccccagctgtgaatattacttggtgctggcccaaacacacattcttaagaagaactttgccaaggcagaggaataccttcaacaagcagcccagatggactacctgaaccccaatgtctggggcctgaagggccatctctattttctgagtggaaatcattctgaggccaaggcatgctatgaacgaaccattagctttgtagtggatgcttctgagatgcacttcatcttcctgagactggggctcatctatctggaagagaaagagctggaggagctcacagaggctgaggatgctctttctgaagccaatgcattgaacaactacaatgctgaagtatgggcatatctggctctggtctgcctgaaagttggacggcaattagaagctgagcaggcctacaagtacatgatcaagctgaaattgaaagatgaggctctgcttgcagagatccacacactacaggaaacagttggctttggaaatccatctttctgatacccctccagctgaacaattttctgcatgggactctgagttcctttccttcccagagagttttaccgtatgaagcctggagctggagaacgaaagaatcttcactataaacagagacccattcatttatttccattggctgtgttactggatgttttactggttgacgagaaactgggtcacaataaaaaaatggagatatgaaactcaaaa

SEQ ID NO: 119755 - DNA, 1514 bp, Homo sapiens
  Payload ID: 3483
  Gene Symbol: CFAP73
  Gene Name: cilia and flagella associated protein 73
  Uniprot ID: A6NFT4
  ENST ID: ENST00000335621
  CDS Start-End: 1-927
atggcggtgccctgggaggaatatttccgactggctttgcaagagaaactgtctacaaagctgccagagcaggctgaggatcatgtcccaccagtactgcgtctcctggagaagaggcaagagctggtagatgcagaccaggccctgcaggcccagaaggaggtgttccgcaccaagacggcagccctgaaacagcgttgggaacagctggaacaaaaggagcgggagctaaagggatcgttcatccgctttgacaagtttttgcaggactccgaggcccggcgcaatcgcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccgggttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgtgaagctgttcatgcaggacctctctgccatgctggccggcctgggtcaggctgagcctgcagcccctgcctcctagccctgacacaggctgacgcagctgctgcccttctgtggccatacagtgctccttttcacagatgatggctcctgcagggagtgcccccagtgcccagcacagggccaggcacacagtggtgcacgggaacgtctgctgatgcccaccctaaggccaatcaaggagccacggggctgggtcctggtcctcacatcctcttccgcatcttgcccttcttggagcgggcaccccggccgaaggcgccctgctgcagctcctggacgcggcggcggttgcgggcagagagctgcttgaggccaccacgctgcaggaagtgcagcttctgggcccggcgccgctgcttcaggatctgctgcttggtcttgagttccgggcggactcggcctgcaggggtgcctggggcgtggggccgggatgcacctgctgggacagggattcagggagctcagctgttgggatcactcccaagatcccctcctcccagaagcttgcagactcctcccctgcccctactcctgttctgtgcttattgctgtggcccagtgtctgtacacagtaggtggctaataaagttttaggcagcctca

SEQ ID NO: 119756 - DNA, 372 bp, Homo sapiens
  Payload ID: 3483
  Gene Symbol: CFAP73
  Gene Name: cilia and flagella associated protein 73
  ENST ID: ENST00000550918
  CDS Start-End: 1-372
gcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccggggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgtgaagctgttcatgcaggacctctctgccatgc

SEQ ID NO: 119757 - DNA, 441 bp, Homo sapiens
  Payload ID: 3484
  Gene Symbol: CFAP74
  Gene Name: cilia and flagella associated protein 74
  ENST ID: ENST00000378590
  CDS Start-End: 1-279
gaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagcgtctcctaaaaactaaaaacattcagcggagagtggtggcgcacgcctgtggtcccagtgacttgggaggctgaggccagaggatggcttgagcccaggaggtcaaggctgcagcaagcctgggtgacagagcaagaccctgtctctaaaaataaaaaactgaaagacaaa

SEQ ID NO: 119758 - DNA, 5247 bp, Homo sapiens
  Payload ID: 3484
  Gene Symbol: CFAP74
  Gene Name: cilia and flagella associated protein 74
  Uniprot ID: Q9C0B2
  ENST ID: ENST00000493964
  CDS Start-End: 157-4911
gttgccatggagctgcccgccccaaaccacgccgccggcgccgcggagggcaatcgccaaggaccgccgcctgcctgagcagcccggggtgtctgtgcctccggagcccgagaacctgggacccaggccagccagagctaatttctatctcccagcatggaggatgacggcagcctgctccctgaggacgagcttttggccgatgcccttcttttggaagatgaaagagatgaattagaggatccggagtttgacatcaaatgtcttctacaggaagctgaggatgacgtggacccgggacacagcagctcagtgaaagaactagatactgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctgtttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcagaaccagagagattaaccacagtgatacctcccagcgaagagcagacggagatcacgctgggggaggtaacagaaggggaaattggccccttcagctccatcaaggtgcccatcgtcttcactccggtcgtcccaggcgacgtccaagccaggttcaaagtcacgtttaagaacccccagtgccccacgctgcatttcagggtcgtgggcgtggccatcgatgtgccggtctgggtgccgaagcccagcgtggacctgaagatctgcatgtatgaccggctctaccaggactctgtgctcgtgcacacgcggtcgaaagctgccctgcgcctgaagttcgaggtgtgcaaggagctgagggcccacctggagctcctgcccaagacaggctatatccaggcacagtcgtcctactccgtgcagctcaagttcctgccgcgacactccctcccggaggacgcagggaggtattttgacaaggagacccgagtcctggaggccccgatgaccatatgggttgccgaccagaacaagccagtgggattcaccgtgcatgccattgtcaccacctcggacctggagctcagtccctcggaggtggattttggctactgcaccatctatgaggccatcaggacggaaatcagcctccacaaccactcgctcctgccccaggagttcgggttcgtcaggcttcccaagtttgtggacgtccaacccaacgatgggtttgggacgatcctgcccctggaaacgctgcagttctgtgtgatcttccagcccaccaaggccgaggaacacagattccaactgacctgcaagtctgagatcaaccggtgcttcaagctgtcttgccgggctgtaggcgtccacccacccctggagctgtcccactaccagatcaagtttgccgccacggccctatacgacacctccgtggctacagtgtacgtcatcaactctcacctgagcatgagctcaccgacccactccaagccccgcattggctcagaggacgcctctcccatggggcccacgtctttcgagttcctgctgcccccagactcgcctatcaccatctcgccctcagtggggaccgtgtggccaggaaagaggtgcctggtccaggtggccttccggccagtgctgcccgagaagctgatccgccaggaagccctcccactcctgaacaaagaaatggagaccaaatctttccgaaagaatatggccccccagaggaaggacctgcatggactgtcattctccgttcttcgagcacagaaccgcgacaagctgttcaaagtctctgtcccccacgtcctggagatgcggaagcgggagctgaggcccagttccgacgagtaccaggccgcccgagccaccctgctcagagcgttccaggcgaagtttgacacatttgtagttccctgtgttgttgccagtggcgacatcaaagacaggaaggggtcagaacccctgagcttcagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaagctgcagaacaactctctgctccccatcaagttctccatgcacctggacagcctctccagcacccggggccggggccagcagcagctgccgcagttcctcagctcgccctcccagaggacggaggtggtcgggacgcagaatctcaacggtcagagcgtgttcagcgtggcccccgtcaagggcgtcatggaccccgggaagacacaagacttcactgtcaccttcagccccgaccacgaaagcctctacttctccgacaagctccaggtggtgctctttgaaaagaaaatctcccaccagatcctgctgaagggtgccgcctgtcagcacatgatgttcgtggagggcggcgaccccctggacgtgcccgtggagtctctgacagcgatccctgtatttgaccccaggcacagagaggaagctgaggagctgaggcccatcctggtgaccctggactacatccagtttgacacagacacgccagccccacctgccacccgagagctgcaggtgggctgtatccggaccacccagccatctccaaagaagccagaccacccactcatggtgtcggccctgctgcagctaaggggggatgtgaaggagacctacaaggtcatctttgtagcccaggtgttgactggcccctaagcctctgcacagagcaccctcgggccctcctgtccaccctcaaagccctccccaggctgagggccaggtcatactaccctagagcctgggacctggccatcctctgccagattccaataggccgccctccacatggcgccacggccacttcctgctgccctggaccccgcaagcccagggacatccaagagcacccctcctgagaccccagactcagaagcagcgagaaggccaggccagccctcagccatcctagccagaccccctcagagcccccagcccccaggagagccctccacagcctgtcaataaattttttgtaggccaacacatgca

SEQ ID NO: 119759 - DNA, 1818 bp, Homo sapiens
  Payload ID: 3485
  Gene Symbol: CFAP77
  Gene Name: cilia and flagella associated protein 77
  Uniprot ID: Q6ZQR2
  ENST ID: ENST00000343036
  CDS Start-End: 49-1011
aagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggctgccggcccggcctcggtgggaacctcttattctgtttatgactcctcagcggtgcagaaagttattccttcccttgctggacaccacatcaaaggaggcccacaggctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacggccttccacacccttctttgatctgctgcagcaccggtacctgcagctgtgggtacaggaacaaaaggccacccagaaagccatcaaactggagaagaagcagaaggtggtccttgggaagctgtatgagacccggagcagtcagctgaggaagtacaagccgcccgtgaagctggacaccctctggcacatgcctcacttccagaaggtgggccgccaccttgatacgttccccacggaggccgatcgccagagagcattaaaagcccaccgggaagagtgtgccgtgcgccaggggaccctgcggatgggcaactacacccacccctagcccctccctcccctgccacaagaagccatcttgacatagtggaaaattcccagaaggactccctatcttgccccaaccctgacattcccccatttttatgcaggttctgcttcaaggagctcagattcaagtcttaggctaattgtttttggtaaaagtccccccttttaggttagccaacattagtctccacttagccccagtgaccctctacctggagcctcctcctctcctcctccttctcctcctagggcaggctcaccctgcctcttctcaagccctcacctgccaagacaagcccaaattacaagacaattttttagactccaggctaagggtcgattccatggctctgcccattaagtgttaagaacgacctgtgtatttgctgcagaaagcatgacagtgacgtgctttgaaagccctcattttctattccaaacatgagttttaattgctctttttgggatgcctgatgtctcatcacggcagtattatctctctgggacctctgacagcaggaagagccaatggttcattactcgagcctgcccccgcctcctcagtgctggggccccgtcaatcaagcaggccaagttggactcctcccccaggactgactttggaaggtcaacccactctggaaaaagccttccaggccagcgggtagactgctgaacacaggctgctgagcttctcagccgaattcctggacacttcctcactcggtctttccgtgtgttctttggattctctctgaaaattttatgctgatctattttaaattaaaaatgctatttgtcatcc

SEQ ID NO: 119760 - DNA, 901 bp, Homo sapiens
  Payload ID: 3485
  Gene Symbol: CFAP77
  Gene Name: cilia and flagella associated protein 77
  ENST ID: ENST00000393215
  CDS Start-End: 230-826
tgaggatcccgcggggctcctgcattgctccggggctctttgcgatgaggggccggcgcgagcggggcgcgcctggctccggaggggtcctggcatctgagtttccccctcaggatcccggtggtgcggcccgggccgcccggcaggcccttcggagctccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacgaaaactttccaaacaaatagaaaagttcagaagcaacataactaactcccgtgaacccactacctggatttagcacgctaaccatctggccgctttcgcttctgatcctttcctttaatattgaagaaataaaacgtgtcaaacacaa

SEQ ID NO: 119761 - DNA, 1638 bp, Homo sapiens
  Payload ID: 3485
  Gene Symbol: CFAP77
  Gene Name: cilia and flagella associated protein 77
  Uniprot ID: Q6ZQR2
  ENST ID: ENST00000393216
  CDS Start-End: 45-899
gcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggctgaactcggcaagccccgggaaagaagctacagtctgcccggcattaattttaattatggactctacatccgagggcttgacggaggagtccctgaagccatcggacgctggaacgtgttcaagcagcagcccacctgcccccacgagctgacccggaattatatcgcaatgaaccgcggggcggtgaaagccggcctggtgactgcccgggagaacttgctctaccgtcagctcaatgacatccgcatcagtgaccaggatgaccggcgcatgaagaaagagccgccccctctccctccaaacatgacatttgggatccgggcacggccttccacacccttctttgatctgctgcagcaccggtacctgcagctgtgggtacaggaacaaaaggccacccagaaagccatcaaactggagaagaagcagaaggtggtccttgggaagctgtatgagacccggagcagtcagctgaggaagtacaagccgcccgtgaagctggacaccctctggcacatgcctcacttccagaaggtgggccgccaccttgatacgttccccacggaggccgatcgccagagagcattaaaagcccaccgggaagagtgtgccgtgcgccaggggaccctgcggatgggcaactacacccacccctagcccctccctcccctgccacaagaagccatcttgacatagtggaaaattcccagaaggactccctatcttgccccaaccctgacattcccccatttttatgcaggttctgcttcaaggagctcagattcaagtcttaggctaattgtttttggtaaaagtccccccttttaggttagccaacattagtctccacttagccccagtgaccctctacctggagcctcctcctctcctcctccttctcctcctagggcaggctcaccctgcctcttctcaagccctcacctgccaagacaagcccaaattacaagacaattttttagactccaggctaagggtcgattccatggctctgcccattaagtgttaagaacgacctgtgtatttgctgcagaaagcatgacagtgacgtgctttgaaagccctcattttctattccaaacatgagttttaattgctctttttgggatgcctgatgtctcatcacggcagtattatctctctgggacctctgacagcaggaagagccaatggttcattactcgagcctgcccccgcctcctcagtgctggggccccgtcaatcaagcaggccaagttggactcctcccccaggactgactttggaaggtcaacccactctggaaaaagccttccaggccagcgggtagactgctgaacacaggctgctgagcttctcagccgaattcctggacacttcctcactcggtctttccgtg

SEQ ID NO: 119762 - DNA, 903 bp, Homo sapiens
  Payload ID: 3486
  Gene Symbol: CFAP97
  Gene Name: cilia and flagella associated protein 97
  ENST ID: ENST00000296775
  CDS Start-End: 85-279
ggagcccgttcagggccgcgggagtgcgccagcgccgcgcgtggggctgtggtggccgcggctctcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagc

SEQ ID NO: 119763 - DNA, 4852 bp, Homo sapiens
  Payload ID: 3486
  Gene Symbol: CFAP97
  Gene Name: cilia and flagella associated protein 97
  Uniprot ID: Q9P2B7
  ENST ID: ENST00000458385
  CDS Start-End: 121-1719
tctctccgcctccggaagcgcgggcgcgcggcgccgggagcccgttcagggccgcgggagtgcgccagcgccgcgcgtggggctgtggtggccgcggctctcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccgggaagcaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttactttgatttatttgattgaaccctggaagtattatttttaccagtcccacatttaaagacctagtaatcttgatggaattggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacctggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatataatctttttatatatataaaaaatcttttttataaattttattttaaaaatcttttaaaaaagatttttatatatatataaagattatatatttatatatagtcttttctgttcataatggcattagtctctgagtacattttatattatctttgttgccacatgtcaggatacaacacaatagttttataaataacaactgtactttgattttaggtactaatttaatgctttagtttttactactttgaaaggggaggttcatctaagtattactgataacagggatccaacttaaagtaaaagttggaaagggcaagagtcttttaagcggaacttcaattctgttgtcatggttacttatatataatgaatataaatagacaaataggacttggaaaatgtggtatattctaagtcaagatgctatgaagttgttatagtttaagggacattcttaagaaggaattacttaagtacattactcttctcatttcaaggacatgaaaaagtaaaggatggtctggcactattttattttattttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtgacggctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataa

SEQ ID NO: 119764 - DNA, 682 bp, Homo sapiens
  Payload ID: 3486
  Gene Symbol: CFAP97
  Gene Name: cilia and flagella associated protein 97
  ENST ID: ENST00000503223
  CDS Start-End: 254-682
gggaggcgcccacccacagcgcgggggcggggtccgggccggggccccacggggagagggcgcgacccagcgcggtgcacacctctctttcccacgctcccctcctcctctacaggatgccgtctgttcatggaaaattttgctgcaggtgtcagcggcgctggtaattcctgagctcagcaaccccgatggataccattatctccatctacacagcggggaactgaagcacaggagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaag

SEQ ID NO: 119765 - DNA, 2895 bp, Homo sapiens
  Payload ID: 3486
  Gene Symbol: CFAP97
  Gene Name: cilia and flagella associated protein 97
  Uniprot ID: Q9P2B7
  ENST ID: ENST00000514798
  CDS Start-End: 261-1622
cacgccgcccctcctttccctttccgctctctccgcctccggaagcgcgggcgcgcggcgccgggagcccgttcagggccgcgggagtgcgccagcgccgcgcgtggggctgtggtggccgcggctctcaggtgaggggcgcgcgagcggctcctggctccctgctcgcggggcgcccgccacgctcctttccgttcgcatccgtctccccgctccggagcccaggcggcggcgagtactcgggatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccgggaagcaaaagtacaattcctagatcggctgatcatcccccaaagttatatcacagtgctctcaacagacagaaggaacaacaaaggattgagagagaaaacttgactatctcgctctgtcacccaggctggagtgcagtgacgtgatcttggctccttgcagcctccatctcctgggttcaagtgattctcctgcctcggcctcccaagtaactggaactacaggcttacaccaccacacccagctaatttttgtatttttagtggagatggtattgccatgttagccaggctggtctcaaactcctgacctcaagtgatccatctgcctcagcttcccaaagagcaaggattacaggtgtgagccactgtgcctggcctgtaggagtaacttcagaactcttatgtggaataattaaagggagattgtgataaattgtcacaaaaatgatttatagcaagtctcatacctactatgaatattaatctgttgattaacagtacttttgttctaagatcttgaaataatgtatactttacttcattggggtttccttcttgtctggttaaggtctgttatctccttccgttgaagaaagcaagctaatgataactcagtgtgactcccactgttgaaatgtagagagcagtcgtcttgattctgcctgtgtgggggacagttgttactttttagtgtccttacaaggtctttgcttcatcgctctagaaacactaaagcaactctcctctgctaacggctgcagaaatcattaagacatttatttgtttacatttgtttaaacatcaaaagatgggctaggttaattttttttccaaagagaataattcctggatataaaataaatgtttggacaagtgtattagtccattttcatactgctgtaaagatactacctgagactgggtaatttataaacaaaagagttttaattgacttacagttctgcaaggctggagaagcctcaggaaacttagaatcatgctggaaggcgaagcagaagcaaggcatgtcttacatggtggcaggatagagagagaacacaggggaaactgccacttttaagtaactcagatctcatgagaactccctcactatcacgagaacagcatgggggaaccacccccatgatccaatcaccttccaccaagtccctccctccatacgtggggattacaattcgagatgagatttgggtggggacacagagtcagaccgtatcaataggtatataacacagtattgttaactatagtcaacatgctgtacattagatctccagaacttactcatcttgcatgactggaactttgtaccttgggtacttgacatttgctaagagactagatcttaggtgttctcaccacacacataaataaaaatggtaactctgtgagatga

SEQ ID NO: 119766 - DNA, 1941 bp, Homo sapiens
  Payload ID: 3487
  Gene Symbol: CFAP99
  Gene Name: cilia and flagella associated protein 99
  ENST ID: ENST00000616117
  CDS Start-End: 1-1941
atggcctactatggaaaatgcattgaaactgtgatcgagcaactcgacaaatttacacccaagagggacaaccctgagcagttcctggaggctgcggccacctccctgcaggctctgagcccccagaagcagagctttgttttggaggttctgtctgggtgcctcgagtaccggaagctgctgaccgtcgtggtggatgccttctacgtggaggatggccgactctgcctgcgggttgaccacagccgcttcgaggtgatctgctacctagccacattcctgctggaggaactcggcttccagctattctgtaacatcatcaagtcccagcccgtggataagatgtgcaagttcctcaggttcttcttcaaccccctgcacctgtgctcatggatcaaggatgagtggagcctcatctacgagccagcccacgtgaaggagaactggatcgaccccctgatgagatggcagccagaggtccaggagctgatcaaccacctggagggcgtgtctgccagtcaatcctctcctttaaagaccaaggccaaggtcacagagcccaaggaattcaacctgactgcccccaggccccgcaccattccagcgcccgaaccagtcccggtcgtggccaagccgagacccgtcccccagagcacctaccagccacccaaggagcagcagcagctggagacagtcaagaggtacaaccgccgaaaggccgaggagctgctgctgagggcaaacatcgaggaactgcgctgcgccatgcccaggtcctgcagggagcgagtgcagggctccaagcagcagctgcggcttcagttcccaccccgaatccgaaagactccgaagctgaccttctataggcctgacaacatcctggtcaagctgaacaccacagccatcctgcgagaaggggccttgtaccagcggcaggtggagcaggagctgcagagggttgataagctcgtggatggggctggggacttctctgagttcttcgagtggcagaagaagatgcaggcgaaggaccgggaggagcagctggctgcaagcgagtgccggcggttgcaagggaagcttagccatgaggaggccgtcctagcccggcagagcctcatgcaggagaacaagcagagggtggagcagcagaaggagcagatggccaagctgatgctgcagcgtgcagagagacggctccgggaggacaggtccaggaaggagctggtggagcaggtgatagaggggcagaagaacgccaaggcggcccagacgaagctcgcgaagggccgacagcagacagttcaggaggcgatcgaggagagcagggggctgctgcagcgcagggcgcaggcagcccaggaggagcagcggcgccgttgtgaactcatctcccagctgcgcgcactcgagacacagcccacgcgcaagggcaagctcgtggacctgacccagatccccggctacggcctggaaggagagatgtccatagtggagctgcgagagcggctggccctgctcaaagagaatcagcggcgcaaggaggaagaaaagcgggatcaaatcattcagggcaagcacaccaagagccaggaactgcagaacatggtggagcagatctcgctgtgccgtgcagccatggggagatccgcagccttgaggtgggaggaaaagaaggcccttgcggcggccccggcggcgccctcgcaggacgagcgcgtgcagcagctgcggcgcaggatctcggagagggcggccgagcgcagcaggcaggcggccttgctgcacgtgtcggcgccgcggaccgcgcgccccaagccccgggcgcagctagaggcgcagcactggctggagctggagcggagccgcgagcgcaggctgcaggcgctgcagcagggaggctcaggacccgggcccgcgcgccgcctggaggccgcctga

SEQ ID NO: 119767 - DNA, 1398 bp, Homo sapiens
  Payload ID: 3488
  Gene Symbol:
  Gene Name: Cilia- and flagella-associated protein 99  [Source:UniProtKB/Swiss-Prot
  Acc:D6REC4]
  Uniprot ID: D6REC4
  ENST ID: ENST00000506607
  CDS Start-End: 4-1383
gccatgcccaggtcctgcagggagcgagtgcagggctccaagcagcagctgcggcttcagttcccaccccgaatccgaaagactccgaagctgaccttctataggcctgacaacatcctggtcaagctgaacaccacagccatcctgcgagaaggggccttgtaccagcggcaggtggagcaggagctgcagagggttgataagctcgtggatggggctggggacttctctgagttcttcgagtggcagaagaagatgcaggcgaaggaccgggaggagcagctggctgcaagcgagtgccggcggttgcaagggaagcttagccatgaggaggccgtcctagcccggcagagcctcatgcaggagaacaagcagagggtggagcagcagaaggagcagatggccaagctgatgctgcagcgtgcagagagacggctccgggaggacaggtccaggaaggagctggtggagcaggtgatagaggggcagaagaacgccaaggcggcccagacgaagctcgcgaagggccgacagcagacagttcaggaggcgatcgaggagagcagggggctgctgcagcgcagggcgcaggcagcccaggaggagcagcggcgccgttgtgaactcatctcccagctgcgcgcactcgagacacagcccacgcgcaagggcaagctcgtggacctgacccagatccccggctacggcctggaaggagagatgtccatagtggagctgcgagagcggctggccctgctcaaagagaatcagcggcgcaaggaggaagaaaagcgggatcaaatcattcagggcaagcacaccaagagccaggaactgcagaacatggtggagcagatctcgctgtgccgtgcagccatggggagatccgcagccttgaggtgggaggaaaagaaggcccttgcggcggccccggcggcgccctcgcaggacgagcgcgtgcagcagctgcggcgcaggatctcggagagggcggccgagcgcagcaggcaggcggccttgctgcacgtgtcggcgccgcggaccgcgcgccccaagccccgggtgagtccggattggtgggaggagcccgggcgactgaaagccggggccgggtggggatggcgggcgcggcgcgcagggaccggcgtcccggggcggggatggcggggagatcgggtccggtccgcggccgggagatacgcagcggcgggcgcgggaggcggtgggggcgtccctgcccgcgccgacgcgttccccggcctgcaggcgcagctagaggcgcagcactggctggagctggagcggagccgcgagcgcaggctgcaggcgctgcagcagggaggctcaggacccgggcccgcgcgccgcctggaggccgcctgagccgggccgagcgcg

SEQ ID NO: 119768 - DNA, 2298 bp, Homo sapiens
  Payload ID: 3488
  Gene Symbol:
  Gene Name: Cilia- and flagella-associated protein 99  [Source:UniProtKB/Swiss-Prot
  Acc:D6REC4]
  ENST ID: ENST00000635017
  CDS Start-End: 138-2282
ctgcctaccgggagctgacggacgacgactgccaacaccttagccccagctggcccaggaaactgctgcggtggcaggtggcggcggcaggagggctcggctgccccgagcgcccgccaggcttctgccctaagaagatggcctactatggaaaatgcattgaaactgtgatcgagcaactcgacaaatttacacccaagagggacaaccctgagcagttcctggaggctgcggccacctccctgcaggctctgagcccccagaagcagagctttgttttggaggttctgtctgggtgcctcgagtaccggaagctgctgaccgtcgtggtggatgccttctacgtggaggatggccgactctgcctgcgggttgaccacagccgcttcgaggtgatctgctacctagccacattcctgctggaggaactcggcttccagctattctgtaacatcatcaagtcccagcccgtggataagatgtgcaagttcctcaggttcttcttcaaccccctgcacctgtgctcatggatcaaggatgagtggagcctcatctacgagccagcccacgtgaaggagaactggatcgaccccctgatgagatggcagccagaggtccaggagctgatcaaccacctggagggcgtgtctgccagtcaatcctctcctttaaagaccaaggccaaggtcacagagcccaaggaattcaacctgactgcccccaggccccgcaccattccagcgcccgaaccagtcccggtcgtggccaagccgagacccgtcccccagagcacctaccagccacccaaggagcagcagcagctggagacagtcaagaggtacaaccgccgaaaggccgaggagctgctgctgagggcaaacatcgaggaactgcgctgcgccatgcccaggtcctgcagggagcgagtgcagggctccaagcagcagctgcggcttcagttcccaccccgaatccgaaagactccgaagctgaccttctataggcctgacaacatcctggtcaagctgaacaccacagccatcctgcgagaaggggccttgtaccagcggcaggtggagcaggagctgcagagggttgataagctcgtggatggggctggggacttctctgagttcttcgagtggcagaagaagatgcaggcgaaggaccgggaggagcagctggctgcaagcgagtgccggcggttgcaagggaagcttagccatgaggaggccgtcctagcccggcagagcctcatgcaggagaacaagcagagggtggagcagcagaaggagcagatggccaagctgatgctgcagcgtgcagagagacggctccgggaggacaggtccaggaaggagctggtggagcaggtgatagaggggcagaagaacgccaaggcggcccagacgaagctcgcgaagggccgacagcagacagttcaggaggcgatcgaggagagcagggggctgctgcagcgcagggcgcaggcagcccaggaggagcagcggcgccgttgtgaactcatctcccagctgcgcgcactcgagacacagcccacgcgcaagggcaagctcgtggacctgacccagatccccggctacggcctggaaggagagatgtccatagtggagctgcgagagcggctggccctgctcaaagagaatcagcggcgcaaggaggaagaaaagcgggatcaaatcattcagggcaagcacaccaagagccaggaactgcagaacatggtggagcagatctcgctgtgccgtgcagccatggggagatccgcagccttgaggtgggaggaaaagaaggcccttgcggcggccccggcggcgccctcgcaggacgagcgcgtgcagcagctgcggcgcaggatctcggagagggcggccgagcgcagcaggcaggcggccttgctgcacgtgtcggcgccgcggaccgcgcgccccaagccccgggtgagtccggattggtgggaggagcccgggcgactgaaagccggggccgggtggggatggcgggcgcggcgcgcagggaccggcgtcccggggcggggatggcggggagatcgggtccggtccgcggccgggagatacgcagcggcgggcgcgggaggcggtgggggcgtccctgcccgcgccgacgcgttccccggcctgcaggcgcagctagaggcgcagcactggctggagctggagcggagccgcgagcgcaggctgcaggcgctgcagcagggaggctcaggacccgggcccgcgcgccgcctggaggccgcctgagccgggccgagcgcgc

SEQ ID NO: 119769 - DNA, 1894 bp, Homo sapiens
  Payload ID: 3489
  Gene Symbol: CNTF
  Gene Name: ciliary neurotrophic factor
  Uniprot ID: P26441
  ENST ID: ENST00000361987
  CDS Start-End: 81-683
agagtcacatctcttatttggaccagtatagacagaagtaaacccagctgacttgtttcctgggacagttgagttaagggatggctttcacagagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtagcagttagtcccttctctcttccttgctttctcttctaatggaatatgcgtagttccctggggcctcgctttcccatcttaaatttctaaaaacagttaagacaacaggcattttctttcttttttctctgaccacctgcagcctgttgaaggactacaggtattttcatcaagtagcgttggagacatacacaaatgggcatacaagtttagcctggggggtgtgatttgtgtgcgtgcttgcatgtgctgcaggtgtaagagagtgggagcagggacaacgtccttccacttcagggttctaacctttctaacccactaagtaacctctacaggcatttaactgccttacagacagaatatacatatgttaattctagtcctggatgactcggtctgagaagattcaatttaaaatcagactctttagttgatttaaactcttagagaataagaataataatggctaacttttattatcttctatattaaggcagtatgccaagggtctttatgtatattatgtacagcgtttacaaccttgtgagcaaggtggtgttactcccattaggtagatgagaaaacaggctcacagagatttggttaagctcacacagctaacaagtagcacactgagtttgaacacagatcattctccttgtaaaagcctatgtgcctttcactttagaggcttgatcatgaatcactgcacctctttgtcacagggtgttggaagatgcatccatgtaatctattcccatcgctggaaaacagctgctgttagatgtcctcagaagtcagttgcaaattttagcgttaaagtcaggatttattgttcatacttggcggtgaggagggcagctggagatcttaagattccattttggaaaatgattaggcccgccaaacttctgaactttggaagctggggatgtttagtaatacagcctggtttttaagtactcactaaaagttctcaaatattgggttgggcacggcttataccaggttacctcacttttaattagtgatgcaggcagtgtaacccaagcatttgtggacaatgagtggaatactaaagttaaaaagtcaaactttcacctcagattttctggacttagtcatgaggagagggtgaggcccactctgttcctactggagataccagagactctgaaactatagaataaagcctctgtgctgcacaacaaa

SEQ ID NO: 119770 - DNA, 1910 bp, Homo sapiens
  Payload ID: 3490
  Gene Symbol: CNTFR
  Gene Name: ciliary neurotrophic factor receptor
  Uniprot ID: P26992
  ENST ID: ENST00000351266
  CDS Start-End: 153-1271
gcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 119771 - DNA, 2052 bp, Homo sapiens
  Payload ID: 3490
  Gene Symbol: CNTFR
  Gene Name: ciliary neurotrophic factor receptor
  Uniprot ID: P26992
  ENST ID: ENST00000378980
  CDS Start-End: 295-1413
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 119772 - DNA, 921 bp, Homo sapiens
  Payload ID: 3490
  Gene Symbol: CNTFR
  Gene Name: ciliary neurotrophic factor receptor
  ENST ID: ENST00000417345
  CDS Start-End: 154-921
gcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcat

SEQ ID NO: 119773 - DNA, 1926 bp, Homo sapiens
  Payload ID: 3490
  Gene Symbol: CNTFR
  Gene Name: ciliary neurotrophic factor receptor
  Uniprot ID: P26992
  ENST ID: ENST00000610543
  CDS Start-End: 171-1289
ccggggctgcgcgtgaagcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatg

SEQ ID NO: 119774 - DNA, 6656 bp, Homo sapiens
  Payload ID: 3491
  Gene Symbol: CROCC
  Gene Name: ciliary rootlet coiled-coil, rootletin
  Uniprot ID: Q5TZA2
  ENST ID: ENST00000375541
  CDS Start-End: 70-6123
gcgtgctgactgagctagtcttggggtcctggagaagggggctggaggcatgcccacagcctcccccccatgagcttggggctggcgggggcacaggaggtggagctgacactagagacggttatccagacactggagagcagcgtcctgtgccaggagaaaggcttgggcgcgcgggacctggcccaggacgctcagatcaccagcctgcctgcccttatcagggagattgtcacccgcaacctctcccagcctgagagcccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagaggctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaagattctccagtacaagaagaggtgctcggagctggagcagcagctgctggagagatccggagagctggagcagcagcggctgagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggctgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggctaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccacccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtg

SEQ ID NO: 119775 - DNA, 3931 bp, Homo sapiens
  Payload ID: 3491
  Gene Symbol: CROCC
  Gene Name: ciliary rootlet coiled-coil, rootletin
  ENST ID: ENST00000445545
  CDS Start-End: 1-3931
cagggagattgtcacccgcaacctctcccagcctgagagcccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggctgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagc

SEQ ID NO: 119776 - DNA, 614 bp, Homo sapiens
  Payload ID: 3491
  Gene Symbol: CROCC
  Gene Name: ciliary rootlet coiled-coil, rootletin
  ENST ID: ENST00000467715
  CDS Start-End: 1-614
ctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcag

SEQ ID NO: 119777 - DNA, 2515 bp, Homo sapiens
  Payload ID: 3491
  Gene Symbol: CROCC
  Gene Name: ciliary rootlet coiled-coil, rootletin
  ENST ID: ENST00000467938
  CDS Start-End: 1-2515
cacccgcaacctctcccagcctgagagcccagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaagattctccagtacaagaagaggtgctcggagctggagcagcagctgctggagagatccggagagctggagcagcagcggctgagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccgggtagg

SEQ ID NO: 119778 - DNA, 5382 bp, Homo sapiens
  Payload ID: 3492
  Gene Symbol: CROCC2
  Gene Name: ciliary rootlet coiled-coil, rootletin family member 2
  Uniprot ID: H7BZ55
  ENST ID: ENST00000443866
  CDS Start-End: 185-5152
ctggccatactgtcttacccacagggcaagagcaactgggtgcccaggctcgggacacaagactgcagagccaggtgccacacaggtgtggggcccgtggaccaaggaagaccctggccagttggaggagaactgccaggtagcaaagcccagacttctctggggtcctgcgctctgggctgcaatgagctctgcctccagtgagcctggcaatggggacgcctcccaacagcccctactggggctggacaccgtgatccagagactggaggacaccatcctgagtcccacagccagcagggaagaccgggcgctgaccgtgcgtggggaaggccggcaggcctcgcccacccccgtgcccacccgcatccgtgagatcgtggccggcagcctgagtgaggagccaccccaagcaggggtacaggagccgacagccactgtggcccgagtgcaagaggagaacgagctcctgcaggaggagctgacccggctgggggacctgctggcccaggccagcgccgagcgagatgagctggccagcaggtgccgtgtggtcagcgagcagctgcaggcccggctggagaccaccgaggctcagctgcggaggtcagagctggagcacagcgtggatctggaggaggcccttggccgtctggaggctgccgaggagaggagcaccggcctctgtcaggtgaacgcgctcctgcgggagcagctggaacatatgaagaaggccaatgacgcgctgggccgggagctggccgggatgacgggcagcgtgcagcgcctgcagggcgagctggagctgaggcgctgggcccagagacagacccggtcagggggcctggggcagccccgggacctcctcctcctgtggagacaggccgtggtgctggggacagacctggccgagctgcgtgtagccactgagaggggcctcgctgacctgcaggcagacacggccaggacagcccgccgcctgcacaccgcctgcctgaacctcgactccaacctgcggctgtcggccagcagcacggccagcaccctggggcagcagcttcgggacaaggctggggagatgctgcagctgcagggccgctgggacgcagagaaggtggcgctccaggccagactctcggagcaaaccctgctggtggagaagcttacagagcagaatgagcagaaggcgaagaccatcgctgccctcagaaccgacctgcagaacctggtggcccaggaggacgcccggtgcctggagctggcaggtagcagcatcactgaattgggggagccacggcgcccactgaggagcccccaacgtgccacatccccccatcaaggggcgtccccaccacacatctgctccccagccaccctggaccccgcactgcaggccatgcgggcagccatagagaggcggtggcggcgggaacaggagctgtgcctgcagctgaagtcctcccaggcactggtggccagtctccaggagcagctgtccgaaagccggcgggagctgtgggccgcacagaagctccagcaggagcgggctcgggagcaggcacgggaacgagaggctcttcggggccagctggaggcccagaggctcgaggtgcagcagtgccgggcatcctgcaagctcctggggagggagaaggctgctctggagatggtggtggaggagctgaaagggaaggcagatgctgcagatgcggagaagcaggggctggaggccgaggctgcagagctgcagagaagcctcctgctgcaggcagagcggagggaggagctggctctgcggagggagcggagctgcagggcactggagaccagtcaaggccgcctgcagcagctggaggagaaggtctccgggctcagagaggagctggcatcggtccgggaggcactgagcacagcacagctgcagcgggatgtcgtggagagtgagagggagggactgcgcagcgccctggcgcgggccgagtgcagcaatgcggacctggagcttcttgtgaggcggctgaagtcggagggagtggagcaaagggactccctggccgcaatggccgccttgatggaggggttggctcaggacaaaagtgccctgaaccacctggctctccagctggagcaggagcgggaccagctgcgggaacagcggaagactctggagcaggaacgggcccgggccggggagcagctggcacaggcggagcagcagctggcgctggagcgggcagagcgcaggggcctgcagcaggcctgcggacgcctggagcagcggcaggagcagctggaggggcaggcagccctgctggggcgagagaaggcccagctccaggagcaggtgggccaggtcacatgccagaaacaggccctggaggagcagctggctcagagcctgcaggaccaggaggcccagatgggcactctgcagcaagccctgcaaggaaaggatgctctgtctgaggagcgggcccagctgctggccaagcaggaggccttggagaggcagggccggctcgcagctgaagaggcagctgatctcagggtggagagggactccctggagagcagcctccttgaggcccaacagctggccacaaagctgcaggagcagctggaggaggaagcccggagcgcaggactcgcgcggcaggccttgcaagtggaaatggagcagctacaaagtgactgggaggtccaggaaatgaagctgcggcaggacacggtgcggctccagcgacaggtggcacagcaggagcgggaggcacagcgggccctggagagccaggcgttggcccaccgagaggccctggcacagctccaaagggagaaggagaccctgagcctgaccctggcagaggagaaggaggtagccagatgccagctggagcaggagaaggagctggtgacaaaaagtgcagctgagagggaggctctgaagggggaaattcagagcctgaagcaggagcgggacgagagccttctccaactggagcacaagatgcaacaggtgatggccctgtccctgaaagaaacagagcggagccttctgagtgaggagctctccagggccaggaggacgctagagcgggtacagcaggaggcacagagccagcaggagcaagcgcaggccaccatcagtgccacgactgaggagctgaaggccctccaggcccagtttgaggatgccatcacagcccatcagagggagaccacggccctacgcgagagcctccaggacctagcggctgagcggggcgatgtggagagagaggctgagaggctgcgggcacagctgaccgtggcccaggagggactggccgcactgcgccaggagctgcagggcgtcgaggagagccgggaggggctgcacagggaggcccaggaggcccgccgggcgctgagtgacgaggcccgcgagaaggacgtactgttgcttttcaacagcgagctgcgggccaccatctgcagggccgaacaggagaaggccagttttaagcggtccaaggaggagaaggagcagaagctgctcatcctggaggaggcccaggcggcgttgcagcaggaggccagtgcactgcgggcccacctgtgggagctggagcaggcagggggggacgcccgtcaggagctccgggaactccacagacaggtgaggacactgaaggccgagaaccagaggaggagtggagaggcccatgagctgcaggcgcagtgctcgcaggaggtgctggagctgcggaggcaggcagccaaggcagaggccaagcacgagggtgcccggaaggaggtcctgggattgcagaggaagttggcagaggtggaggccgcaggggaggcccatggacagcggctccaggagcacctccgtgagagccggggggctgagcagaccctccgagcagagctgcacagtgtcaccaggaagctgcaggaagccagtggtgtggctgatgctctccaggctcgcctggaccaggcctgtcaccgaatccacagcctggagcaggagctggcccaggctgagggtgcaaggcaggatgcggaggcccagctgggccggctgtgctccacgctccgccgtggcctggggctccagagacagagcccgtgggcctccccggagcagcctggttcccccaccaaaggctccgacagctcccaggctctccctgggcaacagggtaccagccccccagccaggccccactcgcccctccgatggccctcgcccacacccggaggccgcagctcagagctcatggatgtggccaccgtgcaggacatcctgcgggactttgtgcagaagctccgggaagcccagcgggagcgggatgactcccgcatccagatggcgaccctgagcagccggctgagcgaggcagagtgcaggtgtgcccgggcccagagccgcgtggggcagctgcagaaagccctggctgaggcggaagaaggccagcgccgggtggagggcgcgctgagcagcgcccgggcagcacgtgccctgcagaaggaggcgctccgcaggctggagttggagcacctggcgagcgtgcgtgcggcaggccaggagaagcggcggctgcaggagcaactggaaacgctgcgccaggctcttgaagagagcaggaggcacagccaaggtctggccaagcaggggaagctgctggaagaacagctcaccaacttggagcacaggtgccagaaggctgaggtatcgctggagcccctgcgacagatggagcaagagacactgaagagggaggaggatgtggcgaggctgggggctgagaaggagcagctggaccagtctctgaacagcctgcaccaggaggtggacggagccctgaggcaaaatcagcagctgcaggcccagatgacagagatggagcaggcccacacccagcggctccaggacctgacagctcagcaccagcgggacctggccacagaggcagagcgtctccatggggcccggccgcaggccacgcaggccctggagtcccaagaatggacccaccagcagcaggtaaaggtgctggaagagcaggtggccagcctgaaggagcaactggaccaggaagtgcagtggcggcaacaggcccacctcggccaggccttccagacaggacacgcccaaagggactgaagctcccagcacaggggaggcgcccagcgtggctgcagaggaagggaacgcaccgcaggtgggaggggcccagctgatttctcagcgtcacagtgaaaggcacccgtgatgagacagctcgctctcggcagtttcaggaccctccttgccctggctgctcatggggaacatttgaaatgcatgtgggggcctccgaattttgaattttaataaatagttgaatcagcgta

SEQ ID NO: 119779 - DNA, 1323 bp, Homo sapiens
  Payload ID: 3493
  Gene Symbol: CATIP
  Gene Name: ciliogenesis associated TTC17 interacting protein
  Uniprot ID: Q7Z7H3
  ENST ID: ENST00000289388
  CDS Start-End: 30-1193
cacagaccgggtagaggcaggcccacagcatgtcctccaaggtttactccacaggctccagagctaaggaccaccagccctcgggtccggagtgtctgccactcccagaggccaatgctgaagccatcgacttcctcagctccctccacaaggaggagctacagatgctgttcttctctgagacgctggccatggtctcagacaccggggagcctcagggagagctgaccattgaggtgcagagagggaaataccaggaaaaactcggcatgctgacatactgcctcttcgtgcatgcctctagccgaggcttcttggacaaaatgctctgcggaaattccctcctgggctatctctcagagaagctggagctcatggaacagcacagccaagacttcatcaagttcctcatcctccccatggaacggaagatgagtttgctgaagcaggatgatcagctggctgtgaccagaagtatcaaggagggtgaggaagtgaagactggagtgacttctttcccctggagctcaatcaagggcttcatctcagaggctgccaacctggtgctgctcagggtgatggcctggcggcggatggtgcccagcaatgcccgcttcctgaccttggacaccgagggcaaactctgctatttgacctatcaaaacctgggcttccagaccatccaggtagaccatcagcaggctgaagtcttcatcgtggagcagactgtccacgcggaggagggcatccccatgtcctgccagtactacctgctctccgatgggcacctggccaagagaatacaggtgggctccccagggtgctgcatcatcaccaagatgcccatcttgagggaagaggatgagattgagccacgcccagtgtttgagaagaagcccctggtatgggaggaggatatggagctctattcgaagttcctggaccggaaggaggagctccggctcggccacgccagctatctgcggcagcaccccgaagcccacgcgctcatctccgacttcctgctcttcctgctgctgcgccagccggaggacgtggtcaccttcgccgccgagttcttcggccccttcgacccgtggcgtccgtcgtcaccggccttgggctcctcccaccggcccaaccctttccgctccctggagccggagggagacgcccgctcgggggcggcctaagcggggcccaggcccggacagggcaggaaaccaggggtcgggctgggacgcgggcgggacgcgccggggcgggtgcgctttccgggctgcggttttgggggaataaatggggccctcccgcttctctgca

SEQ ID NO: 119780 - DNA, 5091 bp, Homo sapiens
  Payload ID: 3494
  Gene Symbol: CGN
  Gene Name: cingulin
  Uniprot ID: Q9P2M7
  ENST ID: ENST00000271636
  CDS Start-End: 134-3745
gaggacgagggggagggccggagctgcgcgtgctgctttgcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaatcatcagcaataagctgatagatggactttccactgtaggagtggacatttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaa

SEQ ID NO: 119781 - DNA, 394 bp, Homo sapiens
  Payload ID: 3494
  Gene Symbol: CGN
  Gene Name: cingulin
  ENST ID: ENST00000416743
  CDS Start-End: 1-394
cacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaagga

SEQ ID NO: 119782 - DNA, 1138 bp, Homo sapiens
  Payload ID: 3494
  Gene Symbol: CGN
  Gene Name: cingulin
  ENST ID: ENST00000427934
  CDS Start-End: 266-1138
agggagctccgaggacgagggggagggccggagctgcgcgtgctgctttgcccgagcccgagcccgagcccgagcccgagcccgagcccgagcccgaacgcaagcctgggagcgcggagcccggctaggacagagtcttactctattgcccaagctggagtgcagtggtgcaattacagctcactgcagcttcaacctcctgggctcaggtgatcctcctgcctcagcctcctaagtcgctgggactacaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcag

SEQ ID NO: 119783 - DNA, 589 bp, Homo sapiens
  Payload ID: 3494
  Gene Symbol: CGN
  Gene Name: cingulin
  ENST ID: ENST00000502442
  CDS Start-End: 80-589
cgtcgggggacaacggagatattttctgcagaaagtgacgaaagagcattctggttcctgcagaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 119784 - DNA, 564 bp, Homo sapiens
  Payload ID: 3494
  Gene Symbol: CGN
  Gene Name: cingulin
  ENST ID: ENST00000505188
  CDS Start-End: 55-564
tgggatcagcatccctactttttgagaggctaactctgaggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccatt

SEQ ID NO: 119785 - DNA, 7224 bp, Homo sapiens
  Payload ID: 3495
  Gene Symbol: CGNL1
  Gene Name: cingulin-like 1
  Uniprot ID: Q0VF96
  ENST ID: ENST00000281282
  CDS Start-End: 79-3987
gcactccggccgggctctgctggctgcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggccacaccggatctcttaaagggccagcaagagctcactcagcaaaccaatgaggagacagctaagcagattctctacaattacctcaaagaaggaagcactgataatgacgatgctactaaaaggaaagtcaacttggtctttgagaaaatccagaccttaaagtctcgagcagctgggagcgcccaaggaaataaccaagcttgtaattccacatctgaagtcaaagatctattggaacagaaaagcaagttgaccatagaagtggctgaacttcagagacagcttcaactggaagtcaagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacagatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactct

SEQ ID NO: 119786 - DNA, 1746 bp, Homo sapiens
  Payload ID: 3496
  Gene Symbol: CIART
  Gene Name: circadian associated repressor of transcription
  Uniprot ID: Q8N365
  ENST ID: ENST00000290363
  CDS Start-End: 450-1607
accaggtgggttcgcgtgcccagattgactgcttgtgggtggcatggcctcaggtggagaggcttgctgcggactcaggctggcgaatagccctggcgaacaacgggcggaggggaaggtgtctttcaagtcggtatttactctgaactgagggaagaaaagaacggaggccgcgtcagaccgagagctgctctgcggcggccagagagggaatcccaagctcttaatgggcgggggtgggggtagaaatgtctttttctattgtgtttgagaccggtaatattggggagggggagaacaagtattatcccacgcagtacaccccaatctcccagttcatttcctaatccttaaactctggtttcaaactccctcgctttgctcttcagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaa

SEQ ID NO: 119787 - DNA, 1179 bp, Homo sapiens
  Payload ID: 3496
  Gene Symbol: CIART
  Gene Name: circadian associated repressor of transcription
  ENST ID: ENST00000369094
  CDS Start-End: 147-1040
cggaggtgggtagatagacccggagagacggcgaaggagctggaaaccgagccagggctgagccggctgacaacaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaa

SEQ ID NO: 119788 - DNA, 1433 bp, Homo sapiens
  Payload ID: 3496
  Gene Symbol: CIART
  Gene Name: circadian associated repressor of transcription
  Uniprot ID: Q8N365
  ENST ID: ENST00000369095
  CDS Start-End: 137-1294
cggaggtgggtagatagacccggagagacggcgaaggagctggaaaccgagccagggctgagccggctgacaacagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctaatttgtgtaaatatttatgtatatatgtatttttactattaatgtgtgcatttgtgttgagggaagataaatcctttctgattaaagaaatttttttatacctaaa

SEQ ID NO: 119789 - DNA, 838 bp, Homo sapiens
  Payload ID: 3496
  Gene Symbol: CIART
  Gene Name: circadian associated repressor of transcription
  ENST ID: ENST00000417398
  CDS Start-End: 123-838
ggagagggcaggaggccagtctctatgggggcggttcccgtaggatcaccaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaa

SEQ ID NO: 119790 - DNA, 771 bp, Homo sapiens
  Payload ID: 3496
  Gene Symbol: CIART
  Gene Name: circadian associated repressor of transcription
  ENST ID: ENST00000447007
  CDS Start-End: 95-771
cggaggtgggtagatagacccggagagacggcgaaggagctggaaaccgagccagggctgagccggctgacaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacc

SEQ ID NO: 119791 - DNA, 2322 bp, Homo sapiens
  Payload ID: 3497
  Gene Symbol: CIRH1A
  Gene Name: cirrhosis, autosomal recessive 1A (cirhin)
  Uniprot ID: Q969X6
  ENST ID: ENST00000314423
  CDS Start-End: 178-2238
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 119792 - DNA, 1841 bp, Homo sapiens
  Payload ID: 3497
  Gene Symbol: CIRH1A
  Gene Name: cirrhosis, autosomal recessive 1A (cirhin)
  Uniprot ID: Q969X6
  ENST ID: ENST00000352319
  CDS Start-End: 43-1758
gagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttg

SEQ ID NO: 119793 - DNA, 586 bp, Homo sapiens
  Payload ID: 3497
  Gene Symbol: CIRH1A
  Gene Name: cirrhosis, autosomal recessive 1A (cirhin)
  ENST ID: ENST00000567235
  CDS Start-End: 143-586
agacgccccggcccgaccgaacgcgcttgctctgtctgcgggttcctaaccttgaagctaggccagtgaggggcgaacaagacctggtctctactctcggccagtatatatgttggcgggcgtcggggggacggggtagggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatc

SEQ ID NO: 119794 - DNA, 737 bp, Homo sapiens
  Payload ID: 3497
  Gene Symbol: CIRH1A
  Gene Name: cirrhosis, autosomal recessive 1A (cirhin)
  ENST ID: ENST00000567500
  CDS Start-End: 1-636
aaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttgaggactagtcattataaa

SEQ ID NO: 119795 - DNA, 4183 bp, Homo sapiens
  Payload ID: 3497
  Gene Symbol: CIRH1A
  Gene Name: cirrhosis, autosomal recessive 1A (cirhin)
  Uniprot ID: Q969X6
  ENST ID: ENST00000563094
  CDS Start-End: 35-1912
cgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggtgagttcttcactgctacctcccaaatcttcttctgaatcttaaagttctaaaagcaacaagtacaataaggtaagaggacagagactcagaataaaggtagctagtaaatcagaatacaggtagctagtacatttcttggaggagaggggcttttgttttacagattccctggtttgtgttcccacagttcttcgggaggctctcggggaaggggctggcctttgtatactggcttttgctgatttgactatttgtctactttgcgagtaagcacataaatcttacacagaaaagtgattaggccagtattcggaaggtgaccctcatccggaagtatcattgatttggctaacttgctttcaactttgaactctggggtatctgaataacctggtttcattaaaggaggtacaggctgaggttttgacctctgtgccccttcgctaaagctactaaaacgctgtctgcaggcttgaggaactggtcttaacatcttcgaaaaacccagctaggaaaattcttcatggctgtgatttacatgggatacgagcattttcttcagttttagattctgtcctctttgccagctgctgttttgattcaccctgaatttgtatggcttttctgggcaggtgctttgtttcctaggagcattgtggccatgcctgtcctgcactttgggcttagattacaaccatcacacggtgttttggtgtgtttgtgaaggtgggggtggaaggaacatgggggaaagcagcagatggctctaaaggaggtgtgcacggggatgtgtcactggaatcatctcgtgggccctgcgacctctgggtgtgggaagcagagctggctgacaagtgccttctgcaagatgagtgatacaggaagggcccctcccactctcttgcctctttgtaattgagcccagatcattttttccaaagcattggctttaagttcatcgcttccttacagtaggcatagctatttcccaggaagtcagagacaaaatatcatttctttggccagaggccacctcgaggtgtcagtgacatcagcacaggtggtttgtgttgaggtttcgcctggggagaactccagtcacttgtccagtctgtgatctggttgggggagagtctagaaagcacagaccctgtgtgggctgagctcctgcacttgccagtttgttccattctgacaaagtgatactgatgagacaggccagaagccgcagaagggccctttgatcttgctgcatggagttaacaagctctctttgcctcatacacccaccctctacagtgtggctgcaagagtagcttcagctctttctccctctctctccttttcttctttttttcccccctagtttttctgaatagaggtattatggctacagctgttttcccgaattaacgaatgtcagggaggtactgaatatatatgatggttagaagatgatgttgggctcaaaatgcactacagatctttggtctgcagaagcccaataaaagtaaccatttaaacaatgtgtctttgtttttttagccccttccaaatgacaaaaccttactctacaatccatttcctcccacgaatgaatcagatgtcatccggaggcgcacagctcatgcttttaaaatttctaagatatataaggtaaaacatcttgtgttgttattctggatagttggttcctttgtgataccaaaatgtaataaactccacaatcggaagataagagcaccttcagtttccatgcagagaacctggcttgtgggagacaagtcacctttttgaggctggctgtcccttgtatatgttttattgttcttgccttagtaggttagaggcaggcacatcatacttaaccaaaatgaaatgcgtaagtagtgagaaatgttggcgctgagggtagagtctttgttgtcatgagagctggctttaaattttacttgttggagtgttccataggataaatgtcaagcaggctgggcttggtagctcatacctgtaatcccagcactttgggaggccaaggcaggtggatctcctcagcccaggaattcaaaaccagcctgggcaccatggtgaaaccccatcactattaacaaaaaaaaaaaaaggagagttctgtaaattactgattactcaaatgactcaaatgtgattagcttcttgatgcatttgtagcttgccagttgtcagttgccttaggctgggtatggtgattcacgcctgtaatctcagtactttaggaggttgaggctggagttcaagaccagtctgggcaacatagtgagaccctgtctctac

SEQ ID NO: 119796 - DNA, 2186 bp, Homo sapiens
  Payload ID: 3497
  Gene Symbol: CIRH1A
  Gene Name: cirrhosis, autosomal recessive 1A (cirhin)
  ENST ID: ENST00000562237
  CDS Start-End: 1-2103
aggagcacttccggggcagagcctgagagcgcgcgcgcacgtggggccggggcggagagaggcgagcaccgggaaggggagcgtggggccgctggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttg

SEQ ID NO: 119797 - DNA, 1619 bp, Homo sapiens
  Payload ID: 3497
  Gene Symbol: CIRH1A
  Gene Name: cirrhosis, autosomal recessive 1A (cirhin)
  Uniprot ID: Q969X6
  ENST ID: ENST00000575702
  CDS Start-End: 1-1535
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 119798 - DNA, 581 bp, Homo sapiens
  Payload ID: 3497
  Gene Symbol: CIRH1A
  Gene Name: cirrhosis, autosomal recessive 1A (cirhin)
  ENST ID: ENST00000563299
  CDS Start-End: 34-581
aattactggtatttgtagcaatgggtggaaaagatggcttcagtcgatctgagttactgcagttttctccatcttctgctactctgcagccccatcttagcctgtcctcctcttaatggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttga

SEQ ID NO: 119799 - DNA, 562 bp, Homo sapiens
  Payload ID: 3497
  Gene Symbol: CIRH1A
  Gene Name: cirrhosis, autosomal recessive 1A (cirhin)
  ENST ID: ENST00000568448
  CDS Start-End: 327-562
cccgaccgaacgcgcttgctctgtctgcgggttcctaaccttgaagctaggccagtgaggggcgaacaagacctggtctctactctcggccagtatatatgttggcgggcgtcggggggacggggtagggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagc

SEQ ID NO: 119800 - DNA, 747 bp, Homo sapiens
  Payload ID: 3497
  Gene Symbol: CIRH1A
  Gene Name: cirrhosis, autosomal recessive 1A (cirhin)
  ENST ID: ENST00000566227
  CDS Start-End: 154-747
ggcggagagaggcgagcaccgggaaggggagcgtggggccgctggaatccgctgtgtggcttacaataaccagtcaaacagattggctgtttcacgaacagatggcactgtggaaatttataacttgtcagcaaactactttcaggagaaattatggtgtttctgcagtttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgac

SEQ ID NO: 119801 - DNA, 595 bp, Homo sapiens
  Payload ID: 3497
  Gene Symbol: CIRH1A
  Gene Name: cirrhosis, autosomal recessive 1A (cirhin)
  ENST ID: ENST00000567460
  CDS Start-End: 168-595
agagcctgagagcgcgcgcgcacgtggggccggggcggagagaggcgagcaccgggaaggggagcgtggggccgctgtttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgg

SEQ ID NO: 119802 - DNA, 3614 bp, Homo sapiens
  Payload ID: 3497
  Gene Symbol: CIRH1A
  Gene Name: cirrhosis, autosomal recessive 1A (cirhin)
  ENST ID: ENST00000634106
  CDS Start-End: 1-1352
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggtgagttcttcactgctacctcccaaatcttcttctgaatcttaaagttctaaaagcaacaagtacaataaggtaagaggacagagactcagaataaaggtagctagtaaatcagaatacaggtagctagtacatttcttggaggagaggggcttttgttttacagattccctggtttgtgttcccacagttcttcgggaggctctcggggaaggggctggcctttgtatactggcttttgctgatttgactatttgtctactttgcgagtaagcacataaatcttacacagaaaagtgattaggccagtattcggaaggtgaccctcatccggaagtatcattgatttggctaacttgctttcaactttgaactctggggtatctgaataacctggtttcattaaaggaggtacaggctgaggttttgacctctgtgccccttcgctaaagctactaaaacgctgtctgcaggcttgaggaactggtcttaacatcttcgaaaaacccagctaggaaaattcttcatggctgtgatttacatgggatacgagcattttcttcagttttagattctgtcctctttgccagctgctgttttgattcaccctgaatttgtatggcttttctgggcaggtgctttgtttcctaggagcattgtggccatgcctgtcctgcactttgggcttagattacaaccatcacacggtgttttggtgtgtttgtgaaggtgggggtggaaggaacatgggggaaagcagcagatggctctaaaggaggtgtgcacggggatgtgtcactggaatcatctcgtgggccctgcgacctctgggtgtgggaagcagagctggctgacaagtgccttctgcaagatgagtgatacaggaagggcccctcccactctcttgcctctttgtaattgagcccagatcattttttccaaagcattggctttaagttcatcgcttccttacagtaggcatagctatttcccaggaagtcagagacaaaatatcatttctttggccagaggccacctcgaggtgtcagtgacatcagcacaggtggtttgtgttgaggtttcgcctggggagaactccagtcacttgtccagtctgtgatctggttgggggagagtctagaaagcacagaccctgtgtgggctgagctcctgcacttgccagtttgttccattctgacaaagtgatactgatgagacaggccagaagccgcagaagggccctttgatcttgctgcatggagttaacaagctctctttgcctcatacacccaccctctacagtgtggctgcaagagtagcttcagctctttctccctctctctccttttcttctttttttcccccctagtttttctgaatagaggtattatggctacagctgttttcccgaattaacgaatgtcagggaggtactgaatatatatgatggttagaagatgatgttgggctcaaaatgcactacagatctttggtctgcagaagcccaataaaagtaaccatttaaacaatgtgtctttgtttttttagccccttccaaatgacaaaaccttactctacaatccatttcctcccacgaatgaatcagatgtcatccggaggcgcacagctcatgcttttaaaatttctaagatatataaggtaaaacatcttgtgttgttattctggatagttggttcctttgtgataccaaaatgtaataaactccacaatcggaagataagagcaccttcagtttccatgcagagaacctggcttgtgggagacaagtcacctttttgaggctggctgtcccttgtatatgttttattgttcttgccttagtaggttagaggcaggcacatcatacttaaccaaaatgaaatgcgtaagtagtgagaaatgttggcgctgagggtagagtctttgttgtcatgagagctggctttaaattttacttgttggagtgttccataggataaatgtcaagcaggctgggcttggtagctcatacctgtaatcccagcactttgggaggccaaggcaggtggatctcctcagcccaggaattcaaaaccagcctgggcaccatggtgaaaccccatcactattaacaaaaaaaaaaaaaggagagttctgtaaattactgattactcaaatgtgattagcttcttgatgcatttgtagcttgccagttgtcagttgccttaggctgggtatggtgattcacgcctgtaatctcagtactttaggaggttgaggctggagttcaagaccagtctgggcaacatagtgagaccctgtctctac

SEQ ID NO: 119803 - DNA, 1618 bp, Homo sapiens
  Payload ID: 3497
  Gene Symbol: CIRH1A
  Gene Name: cirrhosis, autosomal recessive 1A (cirhin)
  ENST ID: ENST00000633692
  CDS Start-End: 1-1535
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttg

SEQ ID NO: 119804 - DNA, 212 bp, Homo sapiens
  Payload ID: 3497
  Gene Symbol: CIRH1A
  Gene Name: cirrhosis, autosomal recessive 1A (cirhin)
  ENST ID: ENST00000631675
  CDS Start-End: 1-212
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgac

SEQ ID NO: 119805 - DNA, 1273 bp, Homo sapiens
  Payload ID: 3497
  Gene Symbol: CIRH1A
  Gene Name: cirrhosis, autosomal recessive 1A (cirhin)
  ENST ID: ENST00000632079
  CDS Start-End: 1-1190
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttg

SEQ ID NO: 119806 - DNA, 151 bp, Homo sapiens
  Payload ID: 3497
  Gene Symbol: CIRH1A
  Gene Name: cirrhosis, autosomal recessive 1A (cirhin)
  ENST ID: ENST00000631541
  CDS Start-End: 1-151
gcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgg

SEQ ID NO: 119807 - DNA, 737 bp, Homo sapiens; identical to SEQ ID NO: 119794
  Payload ID: 3497
  Gene Symbol: CIRH1A
  Gene Name: cirrhosis, autosomal recessive 1A (cirhin)
  ENST ID: ENST00000631682
  CDS Start-End: 1-636

SEQ ID NO: 119808 - DNA, 1169 bp, Homo sapiens
  Payload ID: 3498
  Gene Symbol: CLYBL
  Gene Name: citrate lyase beta like
  Uniprot ID: Q8N0X4
  ENST ID: ENST00000339105
  CDS Start-End: 1-1023
atggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtg

SEQ ID NO: 119809 - DNA, 1127 bp, Homo sapiens
  Payload ID: 3498
  Gene Symbol: CLYBL
  Gene Name: citrate lyase beta like
  Uniprot ID: Q8N0X4
  ENST ID: ENST00000376354
  CDS Start-End: 7-927
gggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttgga

SEQ ID NO: 119810 - DNA, 6771 bp, Homo sapiens
  Payload ID: 3498
  Gene Symbol: CLYBL
  Gene Name: citrate lyase beta like
  Uniprot ID: Q8N0X4
  ENST ID: ENST00000376355
  CDS Start-End: 28-1050
aaagggcggggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgagactctggacgactgttccttaagaaattaacagaatgggaagttttaaactctacaccaaccttttcatgacctacacagcagcaacgctgctactcttagacaaacaccgcggggaaggctgttctgtttatttaaatttgtaaatagaaaacagttgttttttactttcatttttcacctcctcctacgcccttttggattatttcctctgcggcccctagcatgagccccaaccaggcctccccttttccccacttctctcaattcccacaggaagcccgagaggtgaggagctgaggttagacaccaggagaggcaccatcacacaaaagcgcggccgcagagtcccaccgccaccaggcgacccccacccagagagggacagacatgcggggagccagcaccgggcaagatggctctggggatcctcattctgtgaagacaccaactcatttctcaaacacaggatccaggagacagatagctcctaaatggagatggcacatgctccgtggggtccctcatagaggagtgccaccctccacactggccacgctgggctgccccagagcggccagaaaggaaggtgggagctagccccatcctcactcagaggccggaaggaggaagatggcatctcgccaacttcagagccgaatggcctctagccacactgcttccagaccccagacggggcagcagcagcagttcccagaggagcacccattgttgcagctaggacccaccaaggatgggactcctggagtcaggtgcacaccaggtaacccaggaccacgctgtgcacccccagtctgcccctctgctcagaacacagagggatgggaggatggcttggcagtgggaaggcaaaagaaggcctctctcactctgcccctgccatacgcacccgctgagggtgttagaagcagtggaggcagagctggccctaagcaaaagaagaaaataaacctcaccttgtccttcctatgggcagccctcaccccaatctaactaaccttcccatcctccagcctaatccaaagaagcccttggcttgaggggatgaagggcttgcgttctagtctccaccccagccccacaggcagccagccagccagccccacacagaggggcctcctcaaggcctcactgggagcctcctgtccccagccaaggagccctacagacctggggaaaagcaggcccctccgcaaggcccctgggtggtgcggaggccggaccggctaggcctcccgctgctggccactcccaggccacgggttcctaggtcccaaccacattggactgctcgccacgccactgccctcatcccaaactgctttgttcaaacaaaaccaccttgtttcagtctccccaaatgtccagttcattatcttcctcataacccatggtccctattagggtaggatcatgagactaagacctatgagagccacaaatctggaccaaagtcccattccctgaacagagacccaaacgacgagggtcccagaagagagttcagtcctgatcagaaacccatggtgccttagtccttgaagaacaaaactctaggaagaagatgctggaaggcaaagggtattccccctctttccccacccgcgtctctgtggtgccatgggtgggcccaggtaccctgggaaaggtgggagagcagtcaagggtgggtgtgtgatctccactgggctcactgggcacccccgacacggggaagtgagagctgcccgactcctgagccaggcgtgggtgacaggaagaggaccttgcagctaatctgattcattagaaaccatacctgtttatgttttgtgtagctcatcacaagccgcttagccatatcacccccgttattaattcttggggtctaaattatgggtaacactattaaaacattatcagaactaatgagaaacaattacttagaaaatgagccgggacaagactgagttgggaacatcagtggtgatcactgtagattagtttaataaatcatcaggtgcaaggcaagactgactgtatgtatgcaaagccccgtcacgggaaaatgaaattgagattttttttttttgcataattttttcattaatctcaataggacccgtgtggtgtagattgctttattcccctaataccttgcctgaggcgggggggggggggggtgcccaataatgtcttcattgttttactgaggtcttaatgacaatctgtgacaacctcattttaatgtatagaggattatatcaatacagtcatgttttattgaaatggtgaagggaactccagtcagagtcaggcagtgtctgtgagcacaagttaggaagtttctcggcatccgggagcgttcccgtctgatgtcccagtgttagtcctcccggccgccctcccctcctctcctccagggacggctgggaaaacagtcctgcgggatgaagacttcaccgcctccgatttgaatttgaaagtaactccttccgtggcatatttcgctgggcagatagaacaaaccatgtcgttttcccccgtctctaaaatagacatattattatcattcacacttttgcacccggtcgttttgcgggagttcgggaaactgactttcttcattggggacattgtaattttctgatgatgccacgaggagaaaaaaaatacgggtttgttttaattggaaggaccttccgcttttatgatttcggtttaccttggaaaactgaatcttctgtgttttatttctttcctctagtactagaaaagcaatgaattaattgcacaaaacaggttctgagacggcccgcaggccccgagctcgtggacgcggccgagggtcgggtgtgacccgcggagccgctgccaggcttcccagctcgtcttcgcggggaggcgggaggcaggaccagaccccagcatttcagcgtgaaagtcttcgcctttctttccgcgctgtctttcccgcgggcggagcggcgtacctgagcgcggtccccacggaggatcagtgactttcccagaccccgcgggcgagcccgcgcttgggacccggcagctctgcgcgggctggttttggagggggtggtgttcgtttgtttaaattccagttgttatttggcagcatatcgccttccgagtcagtaagaattgcccacgacgtaaagagcgacttgcaggaaggggccgaagccgtcgttagcgcccgggcggcggcggccactcgaaccccgtttccgccaagcgcgctgcaacctgcggggcgagttcgttttgttttgccaaaatcatttggggacttctttgtcattcatgcccttccttttaaatgatttttatttttttccactgtaagtgaccggctgggtttgacttttgcttcttccgacggaagggcaccgcgagccggggtgggcggccccgcgggcaggaggagcgcggggtacacgcggtggccgcagacgccgagccctgcggagccccgaggcctcgtcgcccgcgcccccggtgcgcgcggagccggggccgaggccgggccaggaggagtgtggcggcccaggaggcctggactgtgggccctgctcgcccgcccgccgcgggccgcccggagcccgcgcgcctgtcgcgcagcccggctgtaatggtggcagatcaaaggcggccccgtgtccccgcggagcccgggacaatcccgcgcctttgtgcgctgttgctaggagcccgagaaactaagagaaagtgtcaggagcatgttaatcagactcgttacactgtaacaataacgtctctctcgggtctcccaggccccagtacccccgcgcaccctgcgcgcaggccggacacctgcgcagggcccttgcgcccgccctggggtcccgccggccctggggtccctgcagccccgaatccgcacccgagccacgcggaacgactagccccgaggggccccgcaggctcccggtgcagctccctggtcgtggtctccttgaccgaagccccggcctcacaccgcctggccgcgagcccgagggacgcagggacgatcccggtcccctgcttttcagtcctccagtcgaatcgcccactttgttcaatcacagtattcgaatcaagaggaaaatgaacattccctttatggtagctttttggttatgagttttggcaaaactgttaaatcaactttgccgatttcccttgggaatccctggaggccactctaagtggtaatcccaagtttaagaaggaaatggggaaattttgctgagagtaaagatgtcgccgaactttttgaagggatttgcttcattcattcatttagtcattcaacagacacctgttgaacccgactgggtgccagaggggccagtcacaggacttattccagatgaacttttcttttgaaattagaatgcccttgtggaagccaaaggaggagcagaggcctaaaataatgtcaagtgtcaaagcaaaaagaagtgccattggctactacagtgtgtgatgataacaagagaggtgcgaattaggaattaaaaacgtttgaaaaactacaggcca

SEQ ID NO: 119811 - DNA, 469 bp, Homo sapiens
  Payload ID: 3498
  Gene Symbol: CLYBL
  Gene Name: citrate lyase beta like
  ENST ID: ENST00000425186
  CDS Start-End: 1-270
gaagaactgattgctgcctttaaagaacatcaacaattaggaaaggtaggtcggtattgctgctcttggctttgcattcagccttttccatcatcaccaggtcagcggtcacagagcatctcccgtgtacctggcaggtactgggtgctgggtgccaggtcctgggagtcaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttgg

SEQ ID NO: 119812 - DNA, 386 bp, Homo sapiens
  Payload ID: 3498
  Gene Symbol: CLYBL
  Gene Name: citrate lyase beta like
  ENST ID: ENST00000419700
  CDS Start-End: 1-312
ctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggaagcccgagaggtgaggagctgaggttagacaccaggagaggcaccatc

SEQ ID NO: 119813 - DNA, 610 bp, Homo sapiens
  Payload ID: 3498
  Gene Symbol: CLYBL
  Gene Name: citrate lyase beta like
  ENST ID: ENST00000443887
  CDS Start-End: 1-444
aatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcatagctgccctgcttctagagcactgcattattacttctgttcatttataaaagacacgagcaatagaaagcctgttgcagccccaggcatgctcaggaatatatggcatctcctttgctcctaataaatatattatgtgaacagcctca

SEQ ID NO: 119814 - DNA, 712 bp, Homo sapiens
  Payload ID: 3498
  Gene Symbol: CLYBL
  Gene Name: citrate lyase beta like
  ENST ID: ENST00000416504
  CDS Start-End: 1-546
aatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcatagctgccctgcttctagagcactgcattattacttctgttcatttataaaagacacgagcaatagaaagcctgttgcagccccaggcatgctcaggaatatatggcatctcctttgctcctaataaatatattatgtgaacagcctca

SEQ ID NO: 119815 - DNA, 2975 bp, Homo sapiens
  Payload ID: 3499
  Gene Symbol: CS
  Gene Name: citrate synthase
  Uniprot ID: O75390
  ENST ID: ENST00000351328
  CDS Start-End: 192-1592
cagtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 119816 - DNA, 1893 bp, Homo sapiens
  Payload ID: 3499
  Gene Symbol: CS
  Gene Name: citrate synthase
  ENST ID: ENST00000542324
  CDS Start-End: 256-1617
ccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagctggaaggaattatccattcacctctgcctcaggcttgactgcctctttcctgggatccaactcccaggaagttctgacacttgatgaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttgg

SEQ ID NO: 119817 - DNA, 911 bp, Homo sapiens
  Payload ID: 3499
  Gene Symbol: CS
  Gene Name: citrate synthase
  ENST ID: ENST00000546891
  CDS Start-End: 1-573
ttggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatat

SEQ ID NO: 119818 - DNA, 3057 bp, Homo sapiens
  Payload ID: 3499
  Gene Symbol: CS
  Gene Name: citrate synthase
  ENST ID: ENST00000548567
  CDS Start-End: 472-1674
agtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggcacccagtggcaagtactagctgagcatttgggagatgcttgtcttacttggctgttgcttctcctgctgctggggaaaaggaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 119819 - DNA, 646 bp, Homo sapiens
  Payload ID: 3499
  Gene Symbol: CS
  Gene Name: citrate synthase
  ENST ID: ENST00000550159
  CDS Start-End: 405-646
ctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagcccggcatgccagtgcttcctccacggtaaggtttggaaaagaagactaagaataagaatcattgcggccagcctgaccttggggcagaggatttggcaaccacctggcctcttattatcctgaaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctct

SEQ ID NO: 119820 - DNA, 580 bp, Homo sapiens
  Payload ID: 3499
  Gene Symbol: CS
  Gene Name: citrate synthase
  ENST ID: ENST00000552688
  CDS Start-End: 108-580
cttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagta

SEQ ID NO: 119821 - DNA, 555 bp, Homo sapiens
  Payload ID: 3499
  Gene Symbol: CS
  Gene Name: citrate synthase
  ENST ID: ENST00000552222
  CDS Start-End: 117-344
cctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatggcctgttgcagtggctcatgcctgtaatcccagcactttgggaggctgaggcgggtggctcatctgaggtcaggagttcgagaccagcctggccaacatgatgtatggtggcatgagaggcatgaagggattggtctatgaaacatcagttcttgatcctgatgagggcatccgtttccgaggctttagtatccctgaatgccagaaactgctacccaaggctaagggtggggaagaa

SEQ ID NO: 119822 - DNA, 542 bp, Homo sapiens
  Payload ID: 3499
  Gene Symbol: CS
  Gene Name: citrate synthase
  ENST ID: ENST00000551968
  CDS Start-End: 116-542
ctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcag

SEQ ID NO: 119823 - DNA, 561 bp, Homo sapiens
  Payload ID: 3499
  Gene Symbol: CS
  Gene Name: citrate synthase
  ENST ID: ENST00000548041
  CDS Start-End: 115-561
tttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacagttgatttatgaagactctatggatctaatcgcaaagctaccttgtgtt

SEQ ID NO: 119824 - DNA, 751 bp, Homo sapiens
  Payload ID: 3499
  Gene Symbol: CS
  Gene Name: citrate synthase
  ENST ID: ENST00000551430
  CDS Start-End: 552-751
agtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaaca

SEQ ID NO: 119825 - DNA, 589 bp, Homo sapiens
  Payload ID: 3499
  Gene Symbol: CS
  Gene Name: citrate synthase
  ENST ID: ENST00000550655
  CDS Start-End: 54-589
ctccttgaggaccccgggctgggcgccgccgccgatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaag

SEQ ID NO: 119826 - DNA, 656 bp, Homo sapiens
  Payload ID: 3499
  Gene Symbol: CS
  Gene Name: citrate synthase
  ENST ID: ENST00000547298
  CDS Start-End: 304-656
ctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctgaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagc

SEQ ID NO: 119827 - DNA, 553 bp, Homo sapiens
  Payload ID: 3499
  Gene Symbol: CS
  Gene Name: citrate synthase
  ENST ID: ENST00000549221
  CDS Start-End: 133-553
tttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaaga

SEQ ID NO: 119828 - DNA, 747 bp, Homo sapiens
  Payload ID: 3499
  Gene Symbol: CS
  Gene Name: citrate synthase
  ENST ID: ENST00000550734
  CDS Start-End: 314-747
gtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttg

SEQ ID NO: 119829 - DNA, 551 bp, Homo sapiens
  Payload ID: 3499
  Gene Symbol: CS
  Gene Name: citrate synthase
  ENST ID: ENST00000548746
  CDS Start-End: 1-372
ttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaac

SEQ ID NO: 119830 - DNA, 797 bp, Homo sapiens
  Payload ID: 3499
  Gene Symbol: CS
  Gene Name: citrate synthase
  ENST ID: ENST00000551473
  CDS Start-End: 436-797
agccctgcgtgaagctacaggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctggcacccagtggcaagtactagctgagcatttgggagatgcttgtcttacttggctgttgcttctcctgctgctggggaaaaggaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcaca

SEQ ID NO: 119831 - DNA, 1028 bp, Homo sapiens
  Payload ID: 3499
  Gene Symbol: CS
  Gene Name: citrate synthase
  ENST ID: ENST00000548849
  CDS Start-End: 176-571
cttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcagg

SEQ ID NO: 119832 - DNA, 2811 bp, Homo sapiens
  Payload ID: 3499
  Gene Symbol: CS
  Gene Name: citrate synthase
  ENST ID: ENST00000549143
  CDS Start-End: 118-267
tcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatg

SEQ ID NO: 119833 - DNA, 903 bp, Homo sapiens
  Payload ID: 3499
  Gene Symbol: CS
  Gene Name: citrate synthase
  ENST ID: ENST00000551137
  CDS Start-End: 560-903
ctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaaggcacccagtggcaagtactagctgagcatttgggagatgcttgtcttacttggctgttgcttctcctgctgctggggaaaagggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactt

SEQ ID NO: 119834 - DNA, 676 bp, Homo sapiens
  Payload ID: 3499
  Gene Symbol: CS
  Gene Name: citrate synthase
  ENST ID: ENST00000551253
  CDS Start-End: 255-676
agccctgcgtgaagctacaggaccatgtgccgcgcttcccttctggctcctgggggtgaagtgcacgccgcccgccctcggcccgcagtccagaacgcaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgc

SEQ ID NO: 119835 - DNA, 744 bp, Homo sapiens
  Payload ID: 3499
  Gene Symbol: CS
  Gene Name: citrate synthase
  ENST ID: ENST00000551936
  CDS Start-End: 311-744
caggaccatgtgccgcgcttcccttctggctcctgggggtgaagtgcacgccgcccgccctcggcccgcagtccagaacgcgtgaggaggccgaccctgctgtcaccccgcatgtctgaaatgaaaggggaagggatgcgtggccctgaaatagcaaggagccgagacaggaacctctgcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttg

SEQ ID NO: 119836 - DNA, 568 bp, Homo sapiens
  Payload ID: 3499
  Gene Symbol: CS
  Gene Name: citrate synthase
  ENST ID: ENST00000546930
  CDS Start-End: 130-568
ccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttg

SEQ ID NO: 119837 - DNA, 8578 bp, Homo sapiens
  Payload ID: 3500
  Gene Symbol: CIT
  Gene Name: citron rho-interacting serine/threonine kinase
  Uniprot ID: O14578
  ENST ID: ENST00000261833
  CDS Start-End: 54-6137
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaa

SEQ ID NO: 119838 - DNA, 5205 bp, Homo sapiens
  Payload ID: 3500
  Gene Symbol: CIT
  Gene Name: citron rho-interacting serine/threonine kinase
  ENST ID: ENST00000392520
  CDS Start-End: 1-4922
cccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagc

SEQ ID NO: 119839 - DNA, 8708 bp, Homo sapiens
  Payload ID: 3500
  Gene Symbol: CIT
  Gene Name: citron rho-interacting serine/threonine kinase
  Uniprot ID: O14578
  ENST ID: ENST00000392521
  CDS Start-End: 57-6266
ggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaat

SEQ ID NO: 119840 - DNA, 329 bp, Homo sapiens
  Payload ID: 3500
  Gene Symbol: CIT
  Gene Name: citron rho-interacting serine/threonine kinase
  ENST ID: ENST00000536325
  CDS Start-End: 1-329
atagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcat

SEQ ID NO: 119841 - DNA, 677 bp, Homo sapiens
  Payload ID: 3500
  Gene Symbol: CIT
  Gene Name: citron rho-interacting serine/threonine kinase
  ENST ID: ENST00000546026
  CDS Start-End: 192-677
ggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagaaatccttgtttaaagacaaggcacaaatcagtgctactgatttgcagacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaag

SEQ ID NO: 119842 - DNA, 1799 bp, Homo sapiens
  Payload ID: 3500
  Gene Symbol: CIT
  Gene Name: citron rho-interacting serine/threonine kinase
  Uniprot ID: O14578
  ENST ID: ENST00000612548
  CDS Start-End: 54-1502
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcga

SEQ ID NO: 119843 - DNA, 478 bp, Homo sapiens
  Payload ID: 3501
  Gene Symbol: CKLF-CMTM1
  Gene Name: CKLF-CMTM1 readthrough
  ENST ID: ENST00000529718
  CDS Start-End: 1-195
atcaactcactggtaacaacagtattcatgctcatcgtatctgtgttggcactgataccagaaaccacaacattgacagttggtggaggggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119844 - DNA, 587 bp, Homo sapiens
  Payload ID: 3501
  Gene Symbol: CKLF-CMTM1
  Gene Name: CKLF-CMTM1 readthrough
  ENST ID: ENST00000532838
  CDS Start-End: 68-250
agaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggagggttattttaactcagtataggagctagaggaagagatttccgaagtctgcaccccgcgcagagcactactgtaacttccaagggagcgctgggagcagcgggatcgggttttccggcacccgggcctgggtggcagggaagaatgtgccgggatccgcctcagggatctttgaatctctttactgcctggctggccggcagctccgaggtgtggggttgcagagattttgagttctcgggctaggcggtggcattgcaccccctgtggcaatgagggtggctgaagggctcggcttgtcggtggggcagcgagagccgggtgcacgcgccggggaggtagccaacag

SEQ ID NO: 119845 - DNA, 585 bp, Homo sapiens
  Payload ID: 3501
  Gene Symbol: CKLF-CMTM1
  Gene Name: CKLF-CMTM1 readthrough
  ENST ID: ENST00000527729
  CDS Start-End: 104-451
ggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119846 - DNA, 504 bp, Homo sapiens
  Payload ID: 3501
  Gene Symbol: CKLF-CMTM1
  Gene Name: CKLF-CMTM1 readthrough
  ENST ID: ENST00000527845
  CDS Start-End: 130-231
gagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctgcattgcttggtagtcttcatgtaaggctcagctttattgtgtgtttttaggatattatcaactcactggtaacaacagtattcatgctcatcgtatctgtgttggcactgataccagaaaccacaacattgacagttggtggagggagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggc

SEQ ID NO: 119847 - DNA, 678 bp, Homo sapiens
  Payload ID: 3501
  Gene Symbol: CKLF-CMTM1
  Gene Name: CKLF-CMTM1 readthrough
  ENST ID: ENST00000616804
  CDS Start-End: 38-544
gttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119848 - DNA, 395 bp, Homo sapiens
  Payload ID: 3501
  Gene Symbol: CKLF-CMTM1
  Gene Name: CKLF-CMTM1 readthrough
  ENST ID: ENST00000615332
  CDS Start-End: 38-316
gttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttga

SEQ ID NO: 119849 - DNA, 981 bp, Homo sapiens
  Payload ID: 3502
  Gene Symbol: CMTM1
  Gene Name: CKLF-like MARVEL transmembrane domain containing 1
  ENST ID: ENST00000328020
  CDS Start-End: 1-696
atggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 119850 - DNA, 624 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000332695
  CDS Start-End: 122-490
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119851 - DNA, 883 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000333001
  CDS Start-End: 122-397
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119852 - DNA, 606 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000336328
  CDS Start-End: 122-472
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119853 - DNA, 1064 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000379500
  CDS Start-End: 68-928
ggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 119854 - DNA, 765 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000457188
  CDS Start-End: 122-631
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119855 - DNA, 797 bp, Homo sapiens
  Payload ID: 3502
  Gene Symbol: CMTM1
  Gene Name: CKLF-like MARVEL transmembrane domain containing 1
  ENST ID: ENST00000465057
  CDS Start-End: 1-394
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaagtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119856 - DNA, 924 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000529386
  CDS Start-End: 122-238
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggaagcagacaaagcaaatatgagcaactttaattgaacatgtggaagacccttttagttatggagaggtttctcaggggaaactcaaatctctgtccgtggaaattttcaagaagggaaggtgtaagcttcctgcaaagctgcaaaccactgtacctgcctcagtcaggcctgcccactatgggcagacctctcgctcagcctgcagaacccagctgggacttacttccaacctccaccagccctgctacatacccctgttccagcattaactaccaggcaccaaaacagtaggcattagtgcctttccaagaggcaagatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119857 - DNA, 781 bp, Homo sapiens
  Payload ID: 3502
  Gene Symbol: CMTM1
  Gene Name: CKLF-like MARVEL transmembrane domain containing 1
  ENST ID: ENST00000534143
  CDS Start-End: 1-394
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119858 - DNA, 565 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000533078
  CDS Start-End: 122-220
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119859 - DNA, 749 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000528324
  CDS Start-End: 122-466
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119860 - DNA, 590 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000531885
  CDS Start-End: 122-307
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119861 - DNA, 979 bp, Homo sapiens
  Payload ID: 3502
  Gene Symbol: CMTM1
  Gene Name: CKLF-like MARVEL transmembrane domain containing 1
  ENST ID: ENST00000528441
  CDS Start-End: 1-394
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggtgtaagcttcctgcaaagctgcaaaccactgtacctgcctcagtcaggcctgcccactatgggcagacctctcgctcagcctgcagaacccagctgggacttacttccaacctccaccagccctgctacatacccctgttccagcattaactaccaggcaccaaaacagtaggcattagtgcctttccaagaggcaacggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119862 - DNA, 581 bp, Homo sapiens
  Payload ID: 3502
  Gene Symbol: CMTM1
  Gene Name: CKLF-like MARVEL transmembrane domain containing 1
  ENST ID: ENST00000529506
  CDS Start-End: 235-447
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119863 - DNA, 493 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000533666
  CDS Start-End: 122-208
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 119864 - DNA, 880 bp, Homo sapiens
  Payload ID: 3502
  Gene Symbol: CMTM1
  Gene Name: CKLF-like MARVEL transmembrane domain containing 1
  ENST ID: ENST00000530141
  CDS Start-End: 1-394
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119865 - DNA, 995 bp, Homo sapiens
  Payload ID: 3502
  Gene Symbol: CMTM1
  Gene Name: CKLF-like MARVEL transmembrane domain containing 1
  ENST ID: ENST00000479381
  CDS Start-End: 1-394
aaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggtgtaagcttcctgcaaagctgcaaaccactgtacctgcctcagtcaggcctgcccactatgggcagacctctcgctcagcctgcagaacccagctgggacttacttccaacctccaccagccctgctacatacccctgttccagcattaactaccaggcaccaaaacagtaggcattagtgcctttccaagaggcaatccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119866 - DNA, 899 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000533915
  CDS Start-End: 122-397
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119867 - DNA, 934 bp, Homo sapiens
  Payload ID: 3502
  Gene Symbol: CMTM1
  Gene Name: CKLF-like MARVEL transmembrane domain containing 1
  ENST ID: ENST00000533953
  CDS Start-End: 84-800
gttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactggtgagcggagagctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119868 - DNA, 726 bp, Homo sapiens
  Payload ID: 3502
  Gene Symbol: CMTM1
  Gene Name: CKLF-like MARVEL transmembrane domain containing 1
  Uniprot ID: Q8IZ96
  ENST ID: ENST00000528484
  CDS Start-End: 122-238
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 119869 - DNA, 1054 bp, Homo sapiens
  Payload ID: 3503
  Gene Symbol: CMTM2
  Gene Name: CKLF-like MARVEL transmembrane domain containing 2
  Uniprot ID: Q8TAZ6
  ENST ID: ENST00000268595
  CDS Start-End: 152-898
gttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttgggctgcctaatagctgcaatgatactgttgtcctcactcaccgtgcaccccatcttgaggcttatcatcaccatggagatatccttcttcagcttcttcatcttactgtacagctttgccattcatagatacatacccttcatcctgtggcccatttctgacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaa

SEQ ID NO: 119870 - DNA, 904 bp, Homo sapiens
  Payload ID: 3503
  Gene Symbol: CMTM2
  Gene Name: CKLF-like MARVEL transmembrane domain containing 2
  Uniprot ID: Q8TAZ6
  ENST ID: ENST00000379486
  CDS Start-End: 161-748
ggcgcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttggacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaa

SEQ ID NO: 119871 - DNA, 454 bp, Homo sapiens
  Payload ID: 3503
  Gene Symbol: CMTM2
  Gene Name: CKLF-like MARVEL transmembrane domain containing 2
  ENST ID: ENST00000569316
  CDS Start-End: 149-304
ggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacgctttgccattcatagatacatacccttcatcctgtggcccatttctgacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagag

SEQ ID NO: 119872 - DNA, 2159 bp, Homo sapiens
  Payload ID: 3504
  Gene Symbol: CMTM3
  Gene Name: CKLF-like MARVEL transmembrane domain containing 3
  Uniprot ID: Q96MX0
  ENST ID: ENST00000361909
  CDS Start-End: 356-904
ggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaa

SEQ ID NO: 119873 - DNA, 2330 bp, Homo sapiens
  Payload ID: 3504
  Gene Symbol: CMTM3
  Gene Name: CKLF-like MARVEL transmembrane domain containing 3
  Uniprot ID: Q96MX0
  ENST ID: ENST00000424011
  CDS Start-End: 527-1075
gtgtgtgtgtgtgtgtgtgtgagagagagagatgtgttggggtggggggactgcaggtcaggaagtcctgcagatgtgcgtgcctgtgtgtgtttgcgcgcgcgcgcgcgtgtgtgtgtgtctgtgtgtgtgcctggagctgcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacggcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaa

SEQ ID NO: 119874 - DNA, 792 bp, Homo sapiens
  Payload ID: 3504
  Gene Symbol: CMTM3
  Gene Name: CKLF-like MARVEL transmembrane domain containing 3
  ENST ID: ENST00000562357
  CDS Start-End: 426-792
tgcagatgtgcgtgcctgtgtgtgtttgcgcgcgcgcgcgcgtgtgtgtgtgtctgtgtgtgtgcctggagctgcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgacccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgcca

SEQ ID NO: 119875 - DNA, 714 bp, Homo sapiens
  Payload ID: 3504
  Gene Symbol: CMTM3
  Gene Name: CKLF-like MARVEL transmembrane domain containing 3
  Uniprot ID: Q96MX0
  ENST ID: ENST00000562707
  CDS Start-End: 102-650
gtgtgtgcctggagctgcgcttgcagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggt

SEQ ID NO: 119876 - DNA, 1934 bp, Homo sapiens
  Payload ID: 3504
  Gene Symbol: CMTM3
  Gene Name: CKLF-like MARVEL transmembrane domain containing 3
  Uniprot ID: Q96MX0
  ENST ID: ENST00000567572
  CDS Start-End: 143-691
ggcggggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctg

SEQ ID NO: 119877 - DNA, 615 bp, Homo sapiens
  Payload ID: 3504
  Gene Symbol: CMTM3
  Gene Name: CKLF-like MARVEL transmembrane domain containing 3
  Uniprot ID: Q96MX0
  ENST ID: ENST00000565922
  CDS Start-End: 75-254
ccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcaggg

SEQ ID NO: 119878 - DNA, 460 bp, Homo sapiens
  Payload ID: 3504
  Gene Symbol: CMTM3
  Gene Name: CKLF-like MARVEL transmembrane domain containing 3
  ENST ID: ENST00000563672
  CDS Start-End: 112-460
agactgccggtgaagagggacaaggacaacccgcagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatct

SEQ ID NO: 119879 - DNA, 824 bp, Homo sapiens
  Payload ID: 3504
  Gene Symbol: CMTM3
  Gene Name: CKLF-like MARVEL transmembrane domain containing 3
  ENST ID: ENST00000564060
  CDS Start-End: 75-527
ccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaagg

SEQ ID NO: 119880 - DNA, 572 bp, Homo sapiens
  Payload ID: 3504
  Gene Symbol: CMTM3
  Gene Name: CKLF-like MARVEL transmembrane domain containing 3
  ENST ID: ENST00000566121
  CDS Start-End: 159-449
ttctttgtcctctggacaccggaggcgcccgcactgtccgctgtgggggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagc

SEQ ID NO: 119881 - DNA, 643 bp, Homo sapiens
  Payload ID: 3504
  Gene Symbol: CMTM3
  Gene Name: CKLF-like MARVEL transmembrane domain containing 3
  ENST ID: ENST00000565003
  CDS Start-End: 170-460
gctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagccaggtgctggggccatggggatttgtgaatcccagaaaccgtccttctgctgaaaatgaatgccactcatcccatcccgtcccttggcaaatattaggttagagctcccaggcggtttcctcaggctctgcaacctgctcccagttgcccgcagcaagtgatcccagacaaccagcccagggaccaattagtaaacgtcagtggaaacttg

SEQ ID NO: 119882 - DNA, 687 bp, Homo sapiens
  Payload ID: 3504
  Gene Symbol: CMTM3
  Gene Name: CKLF-like MARVEL transmembrane domain containing 3
  ENST ID: ENST00000568477
  CDS Start-End: 266-556
cggggactcgggcaactcggacctccgggactcccgggccgcagcggggtccgctttcctgcgagcgggtagtgcgggccggggcctcgacctgcggggccgagccggcggggggccgtgcggagcgggagggatcccccacccccgggactggggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccc

SEQ ID NO: 119883 - DNA, 1797 bp, Homo sapiens
  Payload ID: 3504
  Gene Symbol: CMTM3
  Gene Name: CKLF-like MARVEL transmembrane domain containing 3
  ENST ID: ENST00000460097
  CDS Start-End: 252-542
aagaaaactccggcccccaagaaaaagagagggcatgggttgcggagccgacatcacggccggggtctttgctgtttagacgcctgggttcccggatcccagacacgcgcacgggcaggaagttagaccggagacagcgaggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaa

SEQ ID NO: 119884 - DNA, 769 bp, Homo sapiens
  Payload ID: 3504
  Gene Symbol: CMTM3
  Gene Name: CKLF-like MARVEL transmembrane domain containing 3
  ENST ID: ENST00000565666
  CDS Start-End: 327-566
ggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggggtctgtgcctgacactcgggctgtttgtccaagcagatctgaaatgggccgtgaggctggggcagcagcctcccggagcagggagtcagccctgtgatgcatcccatccaccctgtccacaggtgtttggcttctttgctaccatcgtgtttgcaactgatttctacctgatctttaacgacgtggccaaattcctcaaacaaggggactctgcagatgagaccacagcccacaagacagaaggtaagcggctgccctgatcaccccagcagtgctgcaacaggggcctgccctccctcg

SEQ ID NO: 119885 - DNA, 1950 bp, Homo sapiens
  Payload ID: 3504
  Gene Symbol: CMTM3
  Gene Name: CKLF-like MARVEL transmembrane domain containing 3
  ENST ID: ENST00000566756
  CDS Start-End: 66-563
cgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggggtctgtgcctgacactcgggctgtttgtccaagcagatctgaaatgggccgtgaggctggggcagcagcctcccggagcagggagtcagccctgtgatgcatcccatccaccctgtccacaggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctt

SEQ ID NO: 119886 - DNA, 3414 bp, Homo sapiens
  Payload ID: 3505
  Gene Symbol: CMTM4
  Gene Name: CKLF-like MARVEL transmembrane domain containing 4
  Uniprot ID: Q8IZR5
  ENST ID: ENST00000330687
  CDS Start-End: 183-887
agcggaccgagccgcagccgcagccgggcggcgggcgagaggcggcggcggcgggcgggccgcgggcagtcagtcgggcggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacactttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagga

SEQ ID NO: 119887 - DNA, 1187 bp, Homo sapiens
  Payload ID: 3505
  Gene Symbol: CMTM4
  Gene Name: CKLF-like MARVEL transmembrane domain containing 4
  Uniprot ID: Q8IZR5
  ENST ID: ENST00000394106
  CDS Start-End: 183-809
agcggaccgagccgcagccgcagccgggcggcgggcgagaggcggcggcggcgggcgggccgcgggcagtcagtcgggcggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacacgtgaggacctgcctggatcctcctccctcccgtcctcgtgcctgtctctcagtcaagttttctttcccttgtcctgtcagatttccatgtgattcagttgaattttgtcctctttggtaaaagttcattttgggaaagggtttcccgagtggcccagtgggcgggtccgcggtggagttgggaggcccacgttcctcagcgtttggggctgtggagcagccggcgtcactgcccaggtccacttgaggtcttacctgccctgaagcacaggcttcctttgactctgagccaccttgtcgtgtgtatttgtaacaagactttggattaaatggggctgctaagaggggggaaatatgaaggaatgaagggacagcattggaac

SEQ ID NO: 119888 - DNA, 1023 bp, Homo sapiens
  Payload ID: 3505
  Gene Symbol: CMTM4
  Gene Name: CKLF-like MARVEL transmembrane domain containing 4
  Uniprot ID: Q8IZR5
  ENST ID: ENST00000563952
  CDS Start-End: 183-722
agcggaccgagccgcagccgcagccgggcggcgggcgagaggcggcggcggcgggcgggccgcgggcagtcagtcgggcggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacacgtgaggacctgcctggatcctcctccctcccgtcctcgtgcctgtctctcagtcaagttttctttcccttgtcctgtcagatttccatgtgattcagttgaattttgtcctctttggtaaaagttcattttgggaaagggtttcccgagtggcccagtgggcgggtccgcggtggagttgggaggcccacgttcctcagcgtttggggctgtggagcagccggcgtcactgcccaggtccacttgaggtcttacctgccctgaagcacaggcttcctttgactctgagccaccttgtcgtgtgta

SEQ ID NO: 119889 - DNA, 618 bp, Homo sapiens
  Payload ID: 3505
  Gene Symbol: CMTM4
  Gene Name: CKLF-like MARVEL transmembrane domain containing 4
  ENST ID: ENST00000561680
  CDS Start-End: 1-423
tttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacactttttcctactccacaaacgtaacagtaaggaaaaaatcacccacaaacctgctgagtttgaatcactggcaacttgcctagaaaagttcagatgatgggtccttgaactgtgtatctatttcatagggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggaca

SEQ ID NO: 119890 - DNA, 725 bp, Homo sapiens
  Payload ID: 3506
  Gene Symbol: CMTM5
  Gene Name: CKLF-like MARVEL transmembrane domain containing 5
  Uniprot ID: Q96DZ9
  ENST ID: ENST00000342473
  CDS Start-End: 216-440
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 119891 - DNA, 1173 bp, Homo sapiens
  Payload ID: 3506
  Gene Symbol: CMTM5
  Gene Name: CKLF-like MARVEL transmembrane domain containing 5
  Uniprot ID: Q96DZ9
  ENST ID: ENST00000339180
  CDS Start-End: 217-888
cagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctgctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 119892 - DNA, 1200 bp, Homo sapiens
  Payload ID: 3506
  Gene Symbol: CMTM5
  Gene Name: CKLF-like MARVEL transmembrane domain containing 5
  Uniprot ID: Q96DZ9
  ENST ID: ENST00000359320
  CDS Start-End: 445-915
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 119893 - DNA, 378 bp, Homo sapiens
  Payload ID: 3506
  Gene Symbol: CMTM5
  Gene Name: CKLF-like MARVEL transmembrane domain containing 5
  Uniprot ID: Q96DZ9
  ENST ID: ENST00000382809
  CDS Start-End: 1-378
atgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtttttggcatcatcctggtttccatctttgcctatgatgccttcaagatctaccggactgagatggcacccggggccagccagggggaccagcagtga

SEQ ID NO: 119894 - DNA, 818 bp, Homo sapiens
  Payload ID: 3506
  Gene Symbol: CMTM5
  Gene Name: CKLF-like MARVEL transmembrane domain containing 5
  Uniprot ID: Q96DZ9
  ENST ID: ENST00000397227
  CDS Start-End: 216-533
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 119895 - DNA, 831 bp, Homo sapiens
  Payload ID: 3506
  Gene Symbol: CMTM5
  Gene Name: CKLF-like MARVEL transmembrane domain containing 5
  ENST ID: ENST00000555731
  CDS Start-End: 190-546
gagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctgtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 119896 - DNA, 3863 bp, Homo sapiens
  Payload ID: 3507
  Gene Symbol: CMTM6
  Gene Name: CKLF-like MARVEL transmembrane domain containing 6
  Uniprot ID: Q9NX76
  ENST ID: ENST00000205636
  CDS Start-End: 664-1215
cactttgagtctcattcaattcaaagatcatggtcctcagagaggcctttcctgaccactcagtttagtagtggccatttaagtagagcacccaattctccatccttttttccttctccttcctcttctcctcctcctccatcttctttttttttttaataaatttatcaagccaccagaaatgctgaatccattattttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttttaaataaatccatttaattaaaacgtt

SEQ ID NO: 119897 - DNA, 1214 bp, Homo sapiens
  Payload ID: 3508
  Gene Symbol: CMTM7
  Gene Name: CKLF-like MARVEL transmembrane domain containing 7
  Uniprot ID: Q96FZ5
  ENST ID: ENST00000349718
  CDS Start-End: 210-638
ccgggactgccgctacctttctggaaggcgccggccggccagtcaccggagggatcccgccagaggcggctccgcgtctccagcagcggggcagggacccgggcgccccgccctcgccagcgcccgcccccgcccgcccccggcccgccctctgtatctggcccctgggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattga

SEQ ID NO: 119898 - DNA, 2038 bp, Homo sapiens
  Payload ID: 3508
  Gene Symbol: CMTM7
  Gene Name: CKLF-like MARVEL transmembrane domain containing 7
  Uniprot ID: Q96FZ5
  ENST ID: ENST00000334983
  CDS Start-End: 237-764
agtctaacttccgcgcatctacgagggccgggactgccgctacctttctggaaggcgccggccggccagtcaccggagggatcccgccagaggcggctccgcgtctccagcagcggggcagggacccgggcgccccgccctcgccagcgcccgcccccgcccgcccccggcccgccctctgtatctggcccctgggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttgcacaaggatttcttattgaaccagatgaaggctgtaaaacctggcctgaaacagtttccattcgagcttgtgtctggcccatggccctccacccgtgctctgtgtgtgccccttgctgaactgctggacttcaggttttctctccatcttgggggatagtatagcagggcagagttttaggtaaacatgtgcaggttctcaattatattcacgtcctccttctcctgcaataccaatcttctcattttggaaagagctttagagcaagctaagggttgtgtttacactatgatgattaatgatctcggcctaaatgtgctgtttcgctgatcttgagctgctcagttggctagaaaaaggagggatggaacaatgtttgagcaaccccgtgtgcaaggacctacattcacaaccacatctaatagcgatggtagtgactgcaagggggcaggttataggaccacatttttagaaatgaaatcggggctccatccccaggcacagggcaagccagtgaggagctgggctcaggatctaggtctgcctgactcccagccccatccttgcctctgctgagtgttgccggaaatggaagcagcccctgtgggctttgagctggagctctggggctactcttgtggctgctggccagctcggggcatcgggttctgtctgggatgatctaa

SEQ ID NO: 119899 - DNA, 976 bp, Homo sapiens
  Payload ID: 3508
  Gene Symbol: CMTM7
  Gene Name: CKLF-like MARVEL transmembrane domain containing 7
  ENST ID: ENST00000454304
  CDS Start-End: 19-474
gcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcggataatcaaagtccattggcttagccccagcttgcttgtaaatgtaaacccagaccaggcactgaagctgccaagagtgaagaccgagaggcctggctgccagccctgacctggcccaacctggaggactggggccagtggctgggcctcgcggggcttcctctctgcacctgatccaggatgaggtggttgggttagatgactctccaagctcctttctggccagagacatgaagggaacaagcacagagatgagaagcagacaggattgcccgagtaattagccctatggcctgtgaacttcctctcccctctctccactgcagatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggc

SEQ ID NO: 119900 - DNA, 780 bp, Homo sapiens
  Payload ID: 3508
  Gene Symbol: CMTM7
  Gene Name: CKLF-like MARVEL transmembrane domain containing 7
  ENST ID: ENST00000465248
  CDS Start-End: 1-492
gcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcgatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaa

SEQ ID NO: 119901 - DNA, 746 bp, Homo sapiens
  Payload ID: 3508
  Gene Symbol: CMTM7
  Gene Name: CKLF-like MARVEL transmembrane domain containing 7
  ENST ID: ENST00000487007
  CDS Start-End: 1-134
ccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcagacaaactagagcaatgcctatgtaagaacaaggactctcaagatcctgctacacagtattcacaatcaaaagggcccaagattcaggaccacctaaagacaactgacaaaaagtgtcagagccagaggccaacctctgctagatgaagcagcagcacatgactccatttctatctgataaggagacagagaagaggcatctcgaacagatgaaaaaccaaaggctggtgtcctaaaaaaaacagattggcttcaaagaaaacactaaggaagacccacagagctgtattaattttagtaaaaataatcatatgccaacagggga

SEQ ID NO: 119902 - DNA, 1174 bp, Homo sapiens
  Payload ID: 3509
  Gene Symbol: CMTM8
  Gene Name: CKLF-like MARVEL transmembrane domain containing 8
  Uniprot ID: Q8IZV2
  ENST ID: ENST00000307526
  CDS Start-End: 295-816
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaagtaa

SEQ ID NO: 119903 - DNA, 996 bp, Homo sapiens
  Payload ID: 3509
  Gene Symbol: CMTM8
  Gene Name: CKLF-like MARVEL transmembrane domain containing 8
  Uniprot ID: Q8IZV2
  ENST ID: ENST00000458535
  CDS Start-End: 295-642
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaa

SEQ ID NO: 119904 - DNA, 1444 bp, Homo sapiens
  Payload ID: 3510
  Gene Symbol: CLRN1
  Gene Name: clarin 1
  Uniprot ID: P58418
  ENST ID: ENST00000295911
  CDS Start-End: 393-755
tgcctccccaccattcaccaggctccactgcactggctcattcctgcctcagttgtgcttcttttccctggaaagttctttctgtagatctttaaagggtgatttccttctcaacattcaggtgtcagctcgtttcactttcctgaccatgcccatccactcagagatcactcaaaatcccattaccctattttatttctccatcatatgtatcactatctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctggctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgctggtttttccccttaaatcaggaaatacacctggacaatttctagaagactacaattcagtctagccacaaaggggattttttttttttggtaacaggctagagcccggttctgtaagtctttagctgaaatggtccagtacaaaagcactggaaatgagtgggctaggaggacaaggaccgtctcctgcgtgaggagttggttggaggtccccaaggccaggtaccccctgcactcttattggattcctctctgtcttcttggagttttgaaaaactccttcgaacaccaggcttttttctttagaaaacaagtctccaatcgttctctgttccgtagaaagagaaagaaaacctggagcagctgctgaaaaatctaatgaggaactaagaggcaaacccacca

SEQ ID NO: 119905 - DNA, 2359 bp, Homo sapiens
  Payload ID: 3510
  Gene Symbol: CLRN1
  Gene Name: clarin 1
  Uniprot ID: P58418
  ENST ID: ENST00000327047
  CDS Start-End: 292-990
aggagatacttgaaggcagtttgaaagacttgttttacagattcttagtccaaagatttccaattagggagaagaagcagcagaaaaggagaaaagccaagtatgagtgatgatgaggccttcatctactgacatttaacctggcgagaaccgtcgatggtgaagttgccttttcagctgggagctgtccgttcagcttccgtaataaatgcagtcaaagaggcagtcccttcccattgctcacaaaggtcttgtttttgaacctcgccctcacagaagccgtttctcatcatgccaagccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcattttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtactgaaaggcaaacctttctataattttacaagggagtagacttgctttggtcacttttagatgtggttaattttgcatatccttttagtctgcatatattaaagcatcaggacccttcgtgacaatgtttacaaattacgtactaaggatacaggctggaaagtaagggaagcagaaggaaggctttgaaaagttgttttatctggtgggaaattgcttgacccaggtagtcaaaggcagttgactagaatcgacaaattgttactccatatatatatatgtgtgtgtgtgtgtgtgtgtgtgtgtgtaagatgtcttcctatcaaaaagatatcaaaggcacatggaatatattttaataaaaacaaataatatctctaatatatccacacatttgttgccagatttcagaaaactgagctgcaatcgctttcctaaaacagtagtgtattaaatgaacatctataaaatgtatcaacacacattttaaaaaatttgtttaaagtatactcttaggccaggcgtggtgactcacacctgtaattccagcacttcaggaggccaaggtgggaagatcatttgagttcaggagttcgagttacagcctgggcaataaagtgagaccctgtcactaacaaaattaaaaaataaaataaatataaaatataggctttaaaaaagcatagtcttattaaccatgtctgttggtcaaaatctgcaaactctaaaagaagaaaagaagaaaaaaccaagcttagggtatttttcctcccgtgcctgagtcccaattacattcacgacagtactttcaatgaacataattgttaggaccactgaggaatcatgaaaaatgatctctgcttagtacatttgatgcaaaatgacttattaggggctgtttttctagctatagtgtctcgagtactaatatgcaattatgaaaattatattaaatctgggattatgacggtatcactgtatcatcttggtcttgttctggctgtcaccaagcatgacccaggtcaactttttttttcccctgaattacccatcaaattgatctgcagctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgct

SEQ ID NO: 119906 - DNA, 738 bp, Homo sapiens
  Payload ID: 3510
  Gene Symbol: CLRN1
  Gene Name: clarin 1
  Uniprot ID: P58418
  ENST ID: ENST00000328863
  CDS Start-End: 1-738
atgccaagccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcattttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcagttgccctttggctgccagctaccaggcaccaggctcaaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtactga

SEQ ID NO: 119907 - DNA, 704 bp, Homo sapiens
  Payload ID: 3510
  Gene Symbol: CLRN1
  Gene Name: clarin 1
  ENST ID: ENST00000485607
  CDS Start-End: 587-704
tgcctccccaccattcaccaggctccactgcactggctcattcctgcctcagttgtgcttcttttccctggaaagttctttctgtagatctttaaagggtgatttccttctcaacattcaggtgtcagctcgtttcactttcctgaccatgcccatccactcagagatcactcaaaatcccattaccctattttatttctccatcatatgtatcactatctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccaggttataagctctgtgagacaacaggaatcttgtccatcttgttttatggctctacttccaacacctagaataatgcctggcacatatttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtca

SEQ ID NO: 119908 - DNA, 722 bp, Homo sapiens
  Payload ID: 3510
  Gene Symbol: CLRN1
  Gene Name: clarin 1
  ENST ID: ENST00000468836
  CDS Start-End: 377-722
attttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcatgctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtca

SEQ ID NO: 119909 - DNA, 823 bp, Homo sapiens
  Payload ID: 3511
  Gene Symbol: CLRN2
  Gene Name: clarin 2
  Uniprot ID: A0PK11
  ENST ID: ENST00000511148
  CDS Start-End: 103-801
tggaagagctgaccttggagcagagcattgccgagtatctgaaagatgtcaatgaccctcgctgctgctcggagaccttggggatgacctgcacccactagcatgcctggatggttcaaaaaggcgtggtatgggctggcgtctttactcagcttctcctccttcatcctgatcatcgttgccctggtagtgccccactggctgagtgggaaaatcctttgtcagactggagtggatctggtcaacgccacagacagagagctggtcaagttcattggggacatttactacgggctcttccgagggtgtaaagtgcggcagtgtgggcttgggggccgccaatcccaattcacgatcttcccacacctggtgaaggagctcaacgcaggccttcatgtgatgattctgctgctcctcttcctggccttggccctggctctggtcagcatgggctttgccattcttaacatgatccaggtcccgtaccgggcagtcagcggtcctgggggcatctgcctatggaatgtcctggcaggcggcgtcgtggcgttagccatcgccagcttcgtggctgcggtgaaatttcacgacctgacggaacgaatcgccaactttcaggagaagctcttccagtttgtggtggtggaagaacagtatgaagagtcgttttggatctgcgtggccagcgcttcggcccatgctgcaaacttggtcgtggtggcgatcagtcaaattcccctccctgagattaagaccaaaatcgaagaggccacggtcacagctgaggatatcttgtattaatagccttcccctgttcacaacc

SEQ ID NO: 119910 - DNA, 1152 bp, Homo sapiens
  Payload ID: 3512
  Gene Symbol: CLRN3
  Gene Name: clarin 3
  Uniprot ID: Q8NCR9
  ENST ID: ENST00000368671
  CDS Start-End: 164-844
aatgtccattagcataacccttcctcaggaagagtgagattttatatttgacaataaagtgttagactccatttctaaataccagacttcaaaagataaggttcaaaagtgttataagaagatattcctttttttgtcctagagaacttattttcctgtgaaaatgcctaccacaaagaagacattgatgttcttatcaagctttttcaccagccttgggtccttcattgtaatttgctctattcttgggacacaagcatggatcaccagtacaattgctgttagagactctgcttcaaatgggagcattttcatcacttacggactttttcgtggggagagtagtgaagaattgagtcacggacttgcagaaccaaagaaaaagtttgcagttttagagatactgaataattcttcccaaaaaactctgcattcggtgactatcctgttcctggtcctgagtttgatcacgtcgctgctgagctctgggtttaccttctacaacagcatcagcaacccttaccagacattcctggggccgacgggggtgtacacctggaacgggctcggtgcatccttcgtttttgtgaccatgatactgtttgtggcgaacacgcagtccaaccaactctccgaagagttgttccaaatgctttacccggcaaccaccagtaaaggaacgacccacagttacggatactcgttctggctcatactgctcgtcattcttctaaatatagtcactgtaaccatcatcattttctaccagaaggccagataccagcggaagcaggagcagagaaagccaatggaatatgctccaagggacggaattttattctgaattctctttcatctcattttggcgttgcatctattgtacatcagccctgagtagtaactggttagcttctctggacaattcagcatggtaacgtgactgtcatctgtgacagcatttgtgtttcatgacactgtgttcttcattgatgctgtactcctgaaaatttttcccacaaggttggggaaatgaatgggaaatgtcgctggtctgtgtggtattcaaagcagtagtatcatgatgagcgtaacgacccttctgacctggtctcacgatctgaaataataaaaggctgtgtcatgtttcttttc

SEQ ID NO: 119911 - DNA, 4769 bp, Homo sapiens
  Payload ID: 3513
  Gene Symbol: CLSPN
  Gene Name: claspin
  Uniprot ID: Q9HAW4
  ENST ID: ENST00000251195
  CDS Start-End: 98-4096
agcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccaggcatggtggctcacgcctgtaatcccagcactttgggaggccgaggtgggtggatcacaaggtcaggagatcaagaccaacctgaccaacatggtgaaaccccatctctactaaaaatacaaaaattagctgacgtgatgcatgcacctgtaatcccagctactcaggaggctgaggcaggagaatcgcttgaacccgggaggtggaggttgcggtgagccgagattgcgccactgcactccagcctaggcgacagagcgagactccatctcaaaaaaaaaaaaaaaaaaaaaaaaagtgaggatttgggtcaccccaggctgaaggccaggggaacctgaagtggataagggaagggagaagacttaggccacaggatctgatgtagaaatggggctgacgtctccacctgtattttcttagctggaggagtgtgcaaagtttgaattacttctgccttctccttcttatttccttttcccttttaaaatagtcatcataatcataaaaatttcttttcca

SEQ ID NO: 119912 - DNA, 4169 bp, Homo sapiens
  Payload ID: 3513
  Gene Symbol: CLSPN
  Gene Name: claspin
  Uniprot ID: Q9HAW4
  ENST ID: ENST00000318121
  CDS Start-End: 59-4078
cggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatcctt

SEQ ID NO: 119913 - DNA, 3977 bp, Homo sapiens
  Payload ID: 3513
  Gene Symbol: CLSPN
  Gene Name: claspin
  Uniprot ID: Q9HAW4
  ENST ID: ENST00000373220
  CDS Start-End: 59-3886
cggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatcctt

SEQ ID NO: 119914 - DNA, 4010 bp, Homo sapiens
  Payload ID: 3513
  Gene Symbol: CLSPN
  Gene Name: claspin
  ENST ID: ENST00000520551
  CDS Start-End: 59-3919
cggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatcctt

SEQ ID NO: 119915 - DNA, 11952 bp, Homo sapiens
  Payload ID: 3514
  Gene Symbol: CIITA
  Gene Name: class II, major histocompatibility complex, transactivator
  ENST ID: ENST00000324288
  CDS Start-End: 134-3526
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgccactacggaatagttggctaggacccctccatgtgggctagttgggcttcctcatagtatggtggctgggttggagggtgtcccaaaaagaaaggaggggatagagagagaccacttttcataacctagccttagaagtcacacagtattacttctgctacatatatatgttttaagaggcagggtctcactctgtcgcccagtctggaatgcagtggtatgatcacggctcactgcagcctcaacctcctgggctaagtgatcctcccacctcagcctcccgaatagctgggactacaggtgtgagtcaccaagcccagttaatctttagttttatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttcaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtccgaaagggacttggaagctccgctttctacccagcgagctgccggcacgactgttgcttttcactcgggcatagtctgctcagaagccccaattcaagacatcttagcttactcctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtcaccctgcaagggatccctgcacttgcagactctacagaggccatgggcctcctgtgtgtgcgcctacaggagtgagcactaaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagtggcatgatctcggctcactgcaacctctgcctcctgggttcaagcaattctcccacctcagcctcccaagtagctgggattacaggcatgcaccaccacgcctggctaatttttgtatttttagtagagatggagtttcaccatgttggccaggctggtaatctgcctgccttggcctcccaaagtgctgggattacaggggtgagccaccgcacccggccactactgtttatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcaagtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctggaatgttcttcccagctctccatatggctgatttctcatccttcgggacttgccccattctccaaccccatcactagttttatctttttcacttatttatgcagtctgctcttgtcctaggacatgagctccaggagggcgggaaacatctcgctttgtacactgctgtgccctctgtacccagcaaggcgcctgtgtataataggtgctcaataacataaaatgaacaaataatcctcacctaacggtttcattcattctgcaaatacatactgacagcacagtcatgaataagatgttcctgccctggtgagtcttatattttagcaaattaaaaaaactctttggacagggctgccaggtgaggttggccagtctgtacactgcacaaaggcacctgggacaagggggaacatgggggctgcaaaccagtctgggttctgcttgccaaactgggagtcctggtgtggagccttttaacccagaggggcatcttttcgtagttaacgcacagtcatcgtaagatgtggataaattactgtctccgtgtcacagatctaagtgatacttatagtcacactcctataaaggaatggacttctgacttctttggaggacctctctgcagggacaggcacagtgtgccggaagtgcccctgaaccccatttgtcaggtggtaaagcgctgctcggaggaatcagggcatgatagtgcaattccatgtccagtggattgtaagtccacgcaccttccaaatggtcactcttcctcgcaggcctctctctgcatacaaatgtctccctcctgacgctcacctttttccctggggctctcaaatgtcttcttttcagatttcgtagcttttctttctttagcatcacttgagggcaagtggtgctccaactgtctccccccagagttctgccgcctgtactctcccacacctcagtctcctcgcctgtagaaaggggtcaatcgtttgaaccctgcttcacttggtgtgtatgtgaaggtgctttgaaatcaagtgctctgcaaactggagagaattactgcttgtattccgtgaaactacaagctcccaattccactcatttaatccctctcttgctctgttgcccaggctggaatgcagtggcatgatctcaactcactgcaacctctgcctccctggtttcaagcaattctcctgcctcagcctcccgagtagctgggactataagtgtgcgccactatgcctggctaatttttttgtatttttagtagagatggggtttcaccgtggtggccaggctggtctcgaactcctaacctcaagtgatctgcccgcctcggccttccaaagtgctgggattacaggcatgagccaccatgccaagcccttcccccctatctttaatgaaggtctaccatgtgcctgacacaggggatacccacccccacttctatgggattcaggcctggtttccagcttggccttcaggcttttcccaccacaccccaaatgctgtccctggcttgtggagtggggcagggggccagcctgggactttcacgccagcccgactggggcagactctctcaaccccactggatcttctgctgtttgtcagccacaaggttctgcctagaactcctttcccgaatctcaaagttaaaaaaaaaggcagggccccaggggttggagttgcatacatttttttttaatccaaagaagtaagcctcctaagtattgcttagacaggtttatcagaattaagtaggcacaacactcatactttcagaaaagcatttccagccaggggagtaacgtggcactcaccagcatgatgtctgttttgccaacttgctgaagaacgagtaacctgaaatgaaggagcgagaatcccaccctcagccccccaacagcttcctcagcttctttttcttctgagtcacccctgaaacagtcgctgcatctaagaccagcctcgggctaaacccagctggcctgaaggctcaactcacatcaaacggagctgggagtcgcttttgcgtgtgtccgcagtttgaagtgtcctctccgaaggtgaagtgggggaagcaggtgcgctccgggatgaagtgcagggaggcaaactctggctgggttcctgtaaacatccatcgcagctgcaaataatcagaagccaaggccaggccatcgatttgacactgcaggcagatgaggtcttgggatgcctcttgcgttcccccttctgtgggagcaggtgccttcccaacctcagcactcagtcccaatctctcttccactctcctgggttcaaacaggaacctctctgttggcacgaagcttttgaggggagcaggtctaacaagaaggaaaaaggggggttattagcacggaagccccaccctgccaccaggttggctggggacagggaccaatccaccaggctcgggaggcttggggtggggcagggaagtcttcctccatccctcaaatttagggaaccactgggagccccagactcaggctgaaaatgtctttctgcaaatataaaactctttttaatgaatttgcctaatttctcagagaccctgggctggagaaccagtgcaatgtcacacgggagaggaaggactgtcctgtttattgggagggaggagggggatgctggtgcagcctgctcaggagtcacccagggtctgagggctgacttgcagctctgggccagctgagccagcgctgggtagtgggcagggcttggcaacaccttccaccttgcccggaaaaatgctttgcaacctacaggaaggcaatagccacagccaagttactcagcagccccacttggctctttctcccaggatgcagcatcatctccatggcctggccccctggcacgtccccgtttcccactgccttctctgtgtgcctagccgggtgccagtgtctctgtagcacctcgtgttcccatgcccaacccctctgcagccccctcaagccctgctctgattccaagcctcatctcccagctcactatcctttccgcaaacttcactgaacatctcgcagaacttgtatgttaaacatgtgacatgtattgttgtttgacagggtgctattgacatttggggtaggacaattcttggaggtggggtggctgttctgggcactgagcatttagcagcatctctggctccaggccactaaatgccagtagcacccctggccactggaacaactaaaaatgccctcctaccctatttccaaggtcgacctaagggggcggaactgtttccattgagacccatgcatcgtataggataagaaactgaggttcttatcatttaataggataagaaattgaggttcagagaagccaagtaacctgcctaaagatgcacagctatgagaggcaaagctggcactggcttggtaataacgatggaaacggtctgaatgagagcaggtaccatttcctgagctcttagcagacgctgaggaccctgctaagtgccatgagaccttagcagaggctgtgggtgccccgccccattccctccactcactcttccttgcaggtcgacctgcccttctttgctgaggcctttctctgcctccagagcctgcttggtcctcaggctgtaagtgcaggcagagctaatgtctctccatagctgccctccaccagcctgctcctgagacacctgctggccagcagcctgaagcagaatcctttactcagattcagccgcacagatgctcactgcagagatctccaaggcctgtggtcatccttgagcccatctcagatttgtgtggatagggtgttagagaacatggaatcagctggatagagtggttcatgcttgtaatcccagcactttgggaggctggggtgggaggatcacttgaggccaggagtttgagaccagcctgggcaacacagtgagactgtctctataaaaaatttaaaaattagccaggcatagtgtagtctcagctacttggaaggctgaggcaggaggattgcgtgagcccagcagttcaaggctgcagtgaactatgactgtgcccctgcacccagcctgggtgacagagaccctgtctcaaaaaaaagagaagatggaatcactcggtgaggacctcactcctctcccagtcctgtgaccacaaaccgcatccccgacagtcccagccaggcgctagtctggctgtagctgccctcttgtgtgcagatctccagtctgaatgggctacacgtggaatttactaacactccggttttcattgtgtttatctgtagggttaccttctatttatagcaagtgatgccaagtttccatttctggtagtaatatagtttttcttttccaagtcgctcacacctgtaatcccaacactttgggaggctaaggtgggtggatcagttgagatcaggagtttgagaccagcctggccaacatggcgaaatgaggtcaagactagcctggccaacatggcgaaaccgcgtctctactaaaaacaaacaaacaaaaatacaaaattcgctgggcatggtggcaggtgcctgaggtcccagctactcgggaggctgaggcagaagaatcgcttgagctagggaggcagaggttgcagtgagccgagatcacgccactgcactatagcctaggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaaca

SEQ ID NO: 119916 - DNA, 2344 bp, Homo sapiens
  Payload ID: 3514
  Gene Symbol: CIITA
  Gene Name: class II, major histocompatibility complex, transactivator
  Uniprot ID: P33076
  ENST ID: ENST00000381835
  CDS Start-End: 122-1762
ggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagtgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctggtctagcctggtcaccgtgcctgggtctgaggccctccctccacagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgtt

SEQ ID NO: 119917 - DNA, 626 bp, Homo sapiens
  Payload ID: 3514
  Gene Symbol: CIITA
  Gene Name: class II, major histocompatibility complex, transactivator
  ENST ID: ENST00000576601
  CDS Start-End: 95-626
agacttgccgcggccccagagctggcgggagggagaggccaccagcagcgcgcgcgggagcccggggaacagcggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcc

SEQ ID NO: 119918 - DNA, 1041 bp, Homo sapiens
  Payload ID: 3514
  Gene Symbol: CIITA
  Gene Name: class II, major histocompatibility complex, transactivator
  ENST ID: ENST00000571186
  CDS Start-End: 109-627
gctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtcccc

SEQ ID NO: 119919 - DNA, 3363 bp, Homo sapiens
  Payload ID: 3514
  Gene Symbol: CIITA
  Gene Name: class II, major histocompatibility complex, transactivator
  ENST ID: ENST00000611587
  CDS Start-End: 116-2770
tgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagtgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggaagagacatccttgtgttgggcattaactgcggtcttggtgccaagcccagtgctctgtggggttcttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtc

SEQ ID NO: 119920 - DNA, 2844 bp, Homo sapiens
  Payload ID: 3514
  Gene Symbol: CIITA
  Gene Name: class II, major histocompatibility complex, transactivator
  ENST ID: ENST00000618207
  CDS Start-End: 134-1195
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 119921 - DNA, 4657 bp, Homo sapiens
  Payload ID: 3514
  Gene Symbol: CIITA
  Gene Name: class II, major histocompatibility complex, transactivator
  ENST ID: ENST00000618327
  CDS Start-End: 134-3529
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 119922 - DNA, 2248 bp, Homo sapiens
  Payload ID: 3515
  Gene Symbol: CLHC1
  Gene Name: clathrin heavy chain linker domain containing 1
  Uniprot ID: Q8NHS4
  ENST ID: ENST00000401408
  CDS Start-End: 347-2107
aagatgcagttccacctcccagattccctagttactatctctaagcactgaagtcggtgtttggagaaaaggactcaggtgaggactggagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatga

SEQ ID NO: 119923 - DNA, 1777 bp, Homo sapiens
  Payload ID: 3515
  Gene Symbol: CLHC1
  Gene Name: clathrin heavy chain linker domain containing 1
  Uniprot ID: Q8NHS4
  ENST ID: ENST00000406076
  CDS Start-End: 262-1656
cgtgaacttcgtttctcctctccctagcctgggcttatttctcactttagccttcggaatgctttcgaaactgtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaa

SEQ ID NO: 119924 - DNA, 430 bp, Homo sapiens
  Payload ID: 3515
  Gene Symbol: CLHC1
  Gene Name: clathrin heavy chain linker domain containing 1
  ENST ID: ENST00000403506
  CDS Start-End: 291-430
gaggaccatccactgggtgtcgggggagcttctgccccaagtagcaggagggagctgtcaaggcgtggagttcacactcaaacactcccagaggacggcactctgcatgggacgccatccagctcctttgactgtggaatcaagtacattatcagctggcccctggctcctggctgtgacctcccttcgcttgaactgagccttgtgtgcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctga

SEQ ID NO: 119925 - DNA, 2139 bp, Homo sapiens
  Payload ID: 3515
  Gene Symbol: CLHC1
  Gene Name: clathrin heavy chain linker domain containing 1
  Uniprot ID: Q8NHS4
  ENST ID: ENST00000407122
  CDS Start-End: 238-1998
gttaagcggggggcaaagggtgcggggcacgaaaggtgtccttcactcacttccagaagcggtgatgggcagagaatcagcaatctaccagacgctccttgggccttcaagggaagggaatttgcgtggcctgctccaggcaaactgaaaaataggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatga

SEQ ID NO: 119926 - DNA, 549 bp, Homo sapiens
  Payload ID: 3515
  Gene Symbol: CLHC1
  Gene Name: clathrin heavy chain linker domain containing 1
  ENST ID: ENST00000411884
  CDS Start-End: 1-150
ctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtttaatgagttaatctcacttggtgaatatgaaaaggcagcttgttatgcagcaaacagtcctagaagaattcttcgaaacattggtacaatgaatacatttaaggatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgat

SEQ ID NO: 119927 - DNA, 499 bp, Homo sapiens
  Payload ID: 3515
  Gene Symbol: CLHC1
  Gene Name: clathrin heavy chain linker domain containing 1
  ENST ID: ENST00000425841
  CDS Start-End: 448-499
aagtagcaggagggagctgtcaaggcgtggagttcacactcaaacactcccagaggacggcactctgcatgggacgccatccagctcctttgactgtggaatcaagtacattatcagctggcccctggctcctggctgtgacctcccttcgcttgaactgagccttgtgtgtaagggcgtatcaagttgtatgggcttcgccgctgggtgaccccaaatgcaactccaggaagcatgggttaccaatgactttaaggttaacgatcagctgggcgcggtggctgacgcctgtaatcccagcactttgggaggtcgaggcgaatggatcacgaggtcaggagttcaagaccagcctggccaacatggcttatcaaagttttggctttgttgcaagagcaggtcaagatttagctgttcttcagtgaacaagtgtgcagattgtcaaatatgtcagttcatcaaataagaaaacatgcagttctcccacctatcatttgta

SEQ ID NO: 119928 - DNA, 2052 bp, Homo sapiens
  Payload ID: 3515
  Gene Symbol: CLHC1
  Gene Name: clathrin heavy chain linker domain containing 1
  ENST ID: ENST00000428621
  CDS Start-End: 122-400
tctaagcactgaagtcggtgtttggagaaaaggactcaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataagctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgtgggtagtatcctgtgtgttagactgtcttcccaaacatgaaatgctacaagcctgacttgaccagaaaagcaggaaatcatttcaaggttggacttgctggcaaaaacctagagtatagtaattttgtactgctgatttaaagatgcgccccatgctttgatatatataaatatggcaaagcttaggcttctagtataaaagctgggactcttggcatgttattacttagagagaagaccagtcgaattttgcatagaagtagacctgtgatacctataggtatggaaaatatgtcataagaagtggttttggattatttcaagtgtctgaataagtatttgattgaaaactctgaaagttctgtgccatggacaggtgtaatattaaaaatatttaatgattagtatggcatgggcacaaatcaagcagaacagatacctaattaatcagaacagcctttagcccttatgccacaccagagcttactagctaaatgtcatccttgaccatggaacatggttaaaatgagctgctggctgggcaaggtagctcatgtctgtaatcccagcactttgggaggtcgaggcaggaggatcgcttgagcccaggagtttgagaccagctaggtaacacagtgagatcccgtctctgttatt

SEQ ID NO: 119929 - DNA, 616 bp, Homo sapiens
  Payload ID: 3515
  Gene Symbol: CLHC1
  Gene Name: clathrin heavy chain linker domain containing 1
  ENST ID: ENST00000451916
  CDS Start-End: 375-616
tagttctccactgctttcttctaccttggactacttgtcccaagatgcagttccacctcccagattccctagttactatctctaagcactgaagtcggtgtttggagaaaaggactcagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctt

SEQ ID NO: 119930 - DNA, 3440 bp, Homo sapiens
  Payload ID: 3516
  Gene Symbol: CLINT1
  Gene Name: clathrin interactor 1
  Uniprot ID: Q14677
  ENST ID: ENST00000411809
  CDS Start-End: 206-2083
acttccgctccacgcagcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatc

SEQ ID NO: 119931 - DNA, 3987 bp, Homo sapiens
  Payload ID: 3516
  Gene Symbol: CLINT1
  Gene Name: clathrin interactor 1
  Uniprot ID: Q14677
  ENST ID: ENST00000523094
  CDS Start-End: 207-2084
gcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaagcaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaatgttgaactgctttttctttcgttctgttagacatttgagaccatttggggaaaaaataattatagtttgggcaaagtaatttttataaataatttaaaattatttaatgacttctctattctttcctatcagactctactgttaggaattaaaaatgaagcagcaaagatatcctgacctgctccattcttgctaatgttccatctacaacatttctaattaggcagaaattcatgtacttcagctaagtggtaatgaaaagtgattcatttgctgaataagagatgagagtgagtgtaattagctgactgcggtttttaatctttcaacaattcaatgtgtttaacttagtttcaaagaataggagctttcaagtgttgttacttcagagcaatcaagccagcctctggtggccgcatagtagaatatggtccctgatatttaaaaccgatcatcttaagtaaattttttctttaagaagtatatcttcactttctcaaatatgtatggttcttagacgaagtaaatgtttatctgaacctt

SEQ ID NO: 119932 - DNA, 2346 bp, Homo sapiens
  Payload ID: 3516
  Gene Symbol: CLINT1
  Gene Name: clathrin interactor 1
  Uniprot ID: Q14677
  ENST ID: ENST00000523908
  CDS Start-End: 174-2105
gtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgg

SEQ ID NO: 119933 - DNA, 733 bp, Homo sapiens
  Payload ID: 3516
  Gene Symbol: CLINT1
  Gene Name: clathrin interactor 1
  ENST ID: ENST00000521047
  CDS Start-End: 1-166
tcctgctgcctcaaattcttcagacctgtttgatcttatgggctcgtcccaggcaaccatgacatcttcccagagtatgaatttctctatgatgagcactaacactgtgggacttggtttgcctatgtcaagatcacagattctcgtctttggggtattaggatgaaggaaaagaagaaagaagcagaaagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtg

SEQ ID NO: 119934 - DNA, 399 bp, Homo sapiens
  Payload ID: 3516
  Gene Symbol: CLINT1
  Gene Name: clathrin interactor 1
  ENST ID: ENST00000521615
  CDS Start-End: 1-399
cattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaattt

SEQ ID NO: 119935 - DNA, 3344 bp, Homo sapiens
  Payload ID: 3516
  Gene Symbol: CLINT1
  Gene Name: clathrin interactor 1
  Uniprot ID: Q14677
  ENST ID: ENST00000530742
  CDS Start-End: 108-1985
gtcaccggcggcgccgctgctgtggcaaaggaaggagctgactgggggagttcgaggcggcgggcggcggtgaccccggcctggaactgccccgcaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaa

SEQ ID NO: 119936 - DNA, 721 bp, Homo sapiens
  Payload ID: 3516
  Gene Symbol: CLINT1
  Gene Name: clathrin interactor 1
  ENST ID: ENST00000522381
  CDS Start-End: 1-199
tttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagattcttctgtctgttttcgtctggtagatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggcc

SEQ ID NO: 119937 - DNA, 7760 bp, Homo sapiens
  Payload ID: 3517
  Gene Symbol: CLTC
  Gene Name: clathrin, heavy chain (Hc)
  Uniprot ID: Q00610
  ENST ID: ENST00000269122
  CDS Start-End: 275-5302
ggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaa

SEQ ID NO: 119938 - DNA, 5292 bp, Homo sapiens
  Payload ID: 3517
  Gene Symbol: CLTC
  Gene Name: clathrin, heavy chain (Hc)
  Uniprot ID: Q00610
  ENST ID: ENST00000393043
  CDS Start-End: 275-5194
ggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtaatctctctctgtaacctcaaaaaattcattagacaaatatttaattacttagagactgtgcctcaaaatagaatacaacaagcttctaaagtgcaaaaggctttctaagaaa

SEQ ID NO: 119939 - DNA, 479 bp, Homo sapiens
  Payload ID: 3517
  Gene Symbol: CLTC
  Gene Name: clathrin, heavy chain (Hc)
  ENST ID: ENST00000475458
  CDS Start-End: 1-395
tggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggttgatgcaataaaggaaaaggtgaaagttgattctttaacatctttaagtctggaggactaagtctaaggaatttgcatgatgtttttccttcctcttctacactgctgctgctgctttttccccccaataaattttcactaaagc

SEQ ID NO: 119940 - DNA, 2301 bp, Homo sapiens
  Payload ID: 3517
  Gene Symbol: CLTC
  Gene Name: clathrin, heavy chain (Hc)
  ENST ID: ENST00000579456
  CDS Start-End: 201-2039
attgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttct

SEQ ID NO: 119941 - DNA, 575 bp, Homo sapiens
  Payload ID: 3517
  Gene Symbol: CLTC
  Gene Name: clathrin, heavy chain (Hc)
  ENST ID: ENST00000580081
  CDS Start-End: 209-575
gttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaaggtataaaagaatctgggaaaactcttcagatttttaacattgaaatgaaaagtaaaatgaaggctcataccatgactgatgatgtcaccttttggaaatggatctctttgaatacgg

SEQ ID NO: 119942 - DNA, 760 bp, Homo sapiens
  Payload ID: 3517
  Gene Symbol: CLTC
  Gene Name: clathrin, heavy chain (Hc)
  ENST ID: ENST00000483176
  CDS Start-End: 1-73
aacaatttttgttactgcacctcatgaagccacagctggaataattggagtaaacagaaagggacaaaactgagtactttagaagacactggagccttttctgtttcctgtagcagatcttactaaggactggttgctagaaatctgctagaacagtctttaagtatgataacgataaaactgtggattcagtatgtggggaaacctaaggttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaa

SEQ ID NO: 119943 - DNA, 715 bp, Homo sapiens
  Payload ID: 3517
  Gene Symbol: CLTC
  Gene Name: clathrin, heavy chain (Hc)
  ENST ID: ENST00000584313
  CDS Start-End: 190-483
cctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcag

SEQ ID NO: 119944 - DNA, 665 bp, Homo sapiens
  Payload ID: 3517
  Gene Symbol: CLTC
  Gene Name: clathrin, heavy chain (Hc)
  ENST ID: ENST00000472651
  CDS Start-End: 1-665
tgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggttgatgcaataaaggaaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacag

SEQ ID NO: 119945 - DNA, 8587 bp, Homo sapiens
  Payload ID: 3517
  Gene Symbol: CLTC
  Gene Name: clathrin, heavy chain (Hc)
  ENST ID: ENST00000621829
  CDS Start-End: 444-5483
agactggcgaaagtgatgagtctaaaaaagtagtccctccggttcctctgtttccccccatgtggcgtcaggaagcgaggcaccgggcgcactgcgccccgaattcctgcgcccgccgcgcgcggcgctccgtggaggggtacataaggcggagggggtgaggcgactgggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaaggtataaaagaatctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgctataaaac

SEQ ID NO: 119946 - DNA, 574 bp, Homo sapiens
  Payload ID: 3518
  Gene Symbol: CLTCL1
  Gene Name: clathrin, heavy chain-like 1
  ENST ID: ENST00000458188
  CDS Start-End: 1-132
ctctgtgagaaggcaggcctcctgcagcaagcactggagcactacaccgacctctatgacatcaagagggctgtggtccacactcacctcctcaatcccgaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattca

SEQ ID NO: 119947 - DNA, 5513 bp, Homo sapiens
  Payload ID: 3518
  Gene Symbol: CLTCL1
  Gene Name: clathrin, heavy chain-like 1
  Uniprot ID: P53675
  ENST ID: ENST00000427926
  CDS Start-End: 74-4996
cggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 119948 - DNA, 582 bp, Homo sapiens
  Payload ID: 3518
  Gene Symbol: CLTCL1
  Gene Name: clathrin, heavy chain-like 1
  ENST ID: ENST00000449918
  CDS Start-End: 76-582
accggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaaggtgctcccggtttttgctctccagcctctaattctcagtctccaggctcctcactctgtccagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctg

SEQ ID NO: 119949 - DNA, 448 bp, Homo sapiens
  Payload ID: 3518
  Gene Symbol: CLTCL1
  Gene Name: clathrin, heavy chain-like 1
  ENST ID: ENST00000538828
  CDS Start-End: 1-204
ggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggaacagtgtgggtcaggaggcagcgatcgatgagcagcatgccagcgggggagacttctttccggagccagctcagcacatcgggtccatgcagatgtgggcactgggcgtcctcaggggtctcccaaacggaactcagaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagaca

SEQ ID NO: 119950 - DNA, 1714 bp, Homo sapiens
  Payload ID: 3518
  Gene Symbol: CLTCL1
  Gene Name: clathrin, heavy chain-like 1
  ENST ID: ENST00000622493
  CDS Start-End: 91-1200
acagatgaagcttcactcgcttgcctgctgctcacttgctgctatggggcgtgattcctaacaggccacagaccagcagcggtccgtggcatgggggttggggaccgctgctttagtgtgatgcagataaagatcatgagaagcaagccacacgaggaagttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggc

SEQ ID NO: 119951 - DNA, 4859 bp, Homo sapiens
  Payload ID: 3518
  Gene Symbol: CLTCL1
  Gene Name: clathrin, heavy chain-like 1
  ENST ID: ENST00000617103
  CDS Start-End: 21-3803
gccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtt

SEQ ID NO: 119952 - DNA, 1695 bp, Homo sapiens
  Payload ID: 3518
  Gene Symbol: CLTCL1
  Gene Name: clathrin, heavy chain-like 1
  ENST ID: ENST00000617926
  CDS Start-End: 89-1480
agatgaagcttcactcgcttgcctgctgctcacttgctgctatggggcgtgattcctaacaggccacagaccagcagcggtccgtggcatgggggttggggaccgctgctttagtgtgatgcagataaagatcatgagaagcaagccacacgaggaagttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacct

SEQ ID NO: 119953 - DNA, 5313 bp, Homo sapiens
  Payload ID: 3518
  Gene Symbol: CLTCL1
  Gene Name: clathrin, heavy chain-like 1
  Uniprot ID: P53675
  ENST ID: ENST00000621271
  CDS Start-End: 45-4796
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 119954 - DNA, 1073 bp, Homo sapiens
  Payload ID: 3519
  Gene Symbol: CLTA
  Gene Name: clathrin, light chain A
  Uniprot ID: P09496
  ENST ID: ENST00000345519
  CDS Start-End: 135-791
gctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaact

SEQ ID NO: 119955 - DNA, 1152 bp, Homo sapiens
  Payload ID: 3519
  Gene Symbol: CLTA
  Gene Name: clathrin, light chain A
  Uniprot ID: P09496
  ENST ID: ENST00000242285
  CDS Start-End: 121-867
cctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 119956 - DNA, 1090 bp, Homo sapiens
  Payload ID: 3519
  Gene Symbol: CLTA
  Gene Name: clathrin, light chain A
  Uniprot ID: P09496
  ENST ID: ENST00000396603
  CDS Start-End: 95-805
agtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 119957 - DNA, 1235 bp, Homo sapiens
  Payload ID: 3519
  Gene Symbol: CLTA
  Gene Name: clathrin, light chain A
  Uniprot ID: P09496
  ENST ID: ENST00000433436
  CDS Start-End: 202-948
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 119958 - DNA, 695 bp, Homo sapiens
  Payload ID: 3519
  Gene Symbol: CLTA
  Gene Name: clathrin, light chain A
  ENST ID: ENST00000466396
  CDS Start-End: 95-685
agtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccc

SEQ ID NO: 119959 - DNA, 1890 bp, Homo sapiens
  Payload ID: 3519
  Gene Symbol: CLTA
  Gene Name: clathrin, light chain A
  ENST ID: ENST00000464497
  CDS Start-End: 127-909
cgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtttcactcttgcccaggctggagtgcaatggcgtcatctcggctcactgcaacctctgcctcccgggttcaagcaattctcctgcctcagcctcccgaggagctgggattacagacatgtgtcaccgcgcccggctaatttttgtatttttagtagagatggggtttcaccatgttggccaggctggtctcaaaattctgacctcaaatgatctgcccgcctcggccagggcccggattacagggagatggaagggagtcaaggatgttgccatgtatgtgccatctctgccctaagccaatatcatgaagaaatcaacaagaggtggaataaactgagcaattcatcaccatattaagctggatattcctgtttagtaaatatctttccctagctggatgtggtctaggaggaagccttggaattttctcactctggattgtggaaccacaaagtcagcctggagctgcctacatctggacacctaggctcctgtcagagccagtttattatttccagtcactcattactgggattctcctctccctggggcgttatgaaggaattaaaagaaattaaagaggccgggcgcagtggctcacgcctgtaatcccagtaatttgggaggccaaggcaggcggatcacctgaggtccagagttcaagaccagcctgaccaacatagagaaaccctgtctctactaaaaatacaaaaaattagccaggtgtggtggtgcatgcctgtaatcccagctactccagaggctgaggcaggagaatggcttgaacctgggaggcggaggttgctgtgagccgagatcgcacctttgcactctagcctgggcaacaagagcgaaactccgtctcaaaagaaaaaaaaaagaaattaaagaatgtgtaagcaaaaactcagttgtatgtaagaaaacccaattctccctgagaaagaaaaaaagctgaagtcctttaaaaattgactgcctgtttttctgtggctagtgagccttatctctccctttcccaggcattgtgaagactctgtttctctagctgtgtagctgcaaggtcactaggcagataatctcaagtcgtaaaacatgttgttccttggaaagtaagaaatgatgtaatgcatgtcttaattaaataactgtctttgtttcttgcttctgtaatatgcttccccctgcacagatctcccaccgccccacaaaatgcttaaaaggtagcttgactctttgttcatggctcagtcctttggatgttaatccgactggg

SEQ ID NO: 119960 - DNA, 1102 bp, Homo sapiens
  Payload ID: 3519
  Gene Symbol: CLTA
  Gene Name: clathrin, light chain A
  Uniprot ID: P09496
  ENST ID: ENST00000470744
  CDS Start-End: 126-818
gtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 119961 - DNA, 989 bp, Homo sapiens
  Payload ID: 3519
  Gene Symbol: CLTA
  Gene Name: clathrin, light chain A
  Uniprot ID: P09496
  ENST ID: ENST00000540080
  CDS Start-End: 202-702
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 119962 - DNA, 1181 bp, Homo sapiens
  Payload ID: 3519
  Gene Symbol: CLTA
  Gene Name: clathrin, light chain A
  Uniprot ID: P09496
  ENST ID: ENST00000538225
  CDS Start-End: 202-894
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 119963 - DNA, 714 bp, Homo sapiens
  Payload ID: 3519
  Gene Symbol: CLTA
  Gene Name: clathrin, light chain A
  ENST ID: ENST00000493185
  CDS Start-End: 1-195
gcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccagatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactg

SEQ ID NO: 119964 - DNA, 1215 bp, Homo sapiens
  Payload ID: 3520
  Gene Symbol: CLTB
  Gene Name: clathrin, light chain B
  Uniprot ID: P09497
  ENST ID: ENST00000310418
  CDS Start-End: 207-896
ccgctcctcccgccgcggcgcccgcaccgcagtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 119965 - DNA, 1161 bp, Homo sapiens
  Payload ID: 3520
  Gene Symbol: CLTB
  Gene Name: clathrin, light chain B
  Uniprot ID: P09497
  ENST ID: ENST00000345807
  CDS Start-End: 207-842
ccgctcctcccgccgcggcgcccgcaccgcagtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 119966 - DNA, 1489 bp, Homo sapiens
  Payload ID: 3520
  Gene Symbol: CLTB
  Gene Name: clathrin, light chain B
  ENST ID: ENST00000510734
  CDS Start-End: 177-581
agtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctc

SEQ ID NO: 119967 - DNA, 527 bp, Homo sapiens
  Payload ID: 3520
  Gene Symbol: CLTB
  Gene Name: clathrin, light chain B
  ENST ID: ENST00000508425
  CDS Start-End: 1-246
attgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgc

SEQ ID NO: 119968 - DNA, 552 bp, Homo sapiens
  Payload ID: 3520
  Gene Symbol: CLTB
  Gene Name: clathrin, light chain B
  ENST ID: ENST00000502877
  CDS Start-End: 176-552
gtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagca

SEQ ID NO: 119969 - DNA, 3481 bp, Homo sapiens
  Payload ID: 3521
  Gene Symbol: CLDN1
  Gene Name: claudin 1
  Uniprot ID: O95832
  ENST ID: ENST00000295522
  CDS Start-End: 270-905
ctttaaatcgcggcgcccagcggttctgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaggatta

SEQ ID NO: 119970 - DNA, 949 bp, Homo sapiens
  Payload ID: 3522
  Gene Symbol: CLDN10
  Gene Name: claudin 10
  Uniprot ID: P78369
  ENST ID: ENST00000299339
  CDS Start-End: 30-716
ggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaa

SEQ ID NO: 119971 - DNA, 701 bp, Homo sapiens
  Payload ID: 3522
  Gene Symbol: CLDN10
  Gene Name: claudin 10
  ENST ID: ENST00000376855
  CDS Start-End: 9-230
gaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtaagtactcttctcagtctgtttccagctcacaggaagtgtatataaattaatattctcaaccaagagacatgaatttcctatatgacttttgaaagtaagacatactgataaatggtaactgatgacatcattcaagattaaatgtgtcatatgccacatacgcaaaatatgcatttaattagtttgctagtgttgcagtgtcttgtctcgaaacagttcaaggcatcaaatttagaactataaacttcatcgtttgctgtacatcatgaaactgaggtcaagtagaggaaacgtgaaaggtgtcagacggagaggaaagaatgatgcggtgtgcgaatagaaaattaaaaccttgccttgattgttgcccactcaaaatgatatttgccagatgctagtttctgggtcttttaaatttgctgtattaactactgtcttaacaagctcctcctaataaacctttataaagaaa

SEQ ID NO: 119972 - DNA, 2656 bp, Homo sapiens
  Payload ID: 3522
  Gene Symbol: CLDN10
  Gene Name: claudin 10
  Uniprot ID: P78369
  ENST ID: ENST00000376873
  CDS Start-End: 231-911
atatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcaccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccataccttga

SEQ ID NO: 119973 - DNA, 2169 bp, Homo sapiens
  Payload ID: 3523
  Gene Symbol: CLDN11
  Gene Name: claudin 11
  Uniprot ID: O75508
  ENST ID: ENST00000064724
  CDS Start-End: 203-826
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaa

SEQ ID NO: 119974 - DNA, 1139 bp, Homo sapiens
  Payload ID: 3523
  Gene Symbol: CLDN11
  Gene Name: claudin 11
  ENST ID: ENST00000486975
  CDS Start-End: 200-697
agcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggctgtcagcttctttgggcaaagactgagtcatctctgcattctcagcacctggtgcaatttaagcagaaatatcttgaagatttttcgtatcttcagggagattaggaatgggaatggaatgggaacgccaatgcaggaaggatgagaagtctgcagatgcctccaaggagtccgaaaccaagtccgaagtcaacgacaagcaatgatggcgatggcgatcctagttaataaaaaggggggagatgtgggctgcaagccacccaggtgccgaggcaagagaccgaggacatgagctgttccagtataataaaatataaaacaagaatagttataccagatatagatcttagatatgattatatatgaatataattaatcattagtttgtggcaattactctttattccaatattataataatcctcgctctataatcataacctaggaaaaaccaggccatacagagataggagctgaggggacatagtgaggagtgaccagaagacaagagtgcgagccttctgttatgcccagacagggccaccag

SEQ ID NO: 119975 - DNA, 3565 bp, Homo sapiens
  Payload ID: 3524
  Gene Symbol: CLDN12
  Gene Name: claudin 12
  Uniprot ID: P56749
  ENST ID: ENST00000287916
  CDS Start-End: 288-1022
gccatccagggcattgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 119976 - DNA, 846 bp, Homo sapiens
  Payload ID: 3524
  Gene Symbol: CLDN12
  Gene Name: claudin 12
  ENST ID: ENST00000394604
  CDS Start-End: 285-846
ggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcgtaaatgaagaaaacgaggcacagggaagttctgaatctggcccaaggtcagtgagctatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatga

SEQ ID NO: 119977 - DNA, 3488 bp, Homo sapiens
  Payload ID: 3524
  Gene Symbol: CLDN12
  Gene Name: claudin 12
  Uniprot ID: P56749
  ENST ID: ENST00000394605
  CDS Start-End: 211-945
gcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcgtaatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaatggggaaatagttaattgttaaagaaaacttcttgtagcctcacattccccttgtgcaaagagctcttttggacctacatacattttcctttgtttttgaccaatcaatgaagccaaatttatatgtcctagtagaatgaagtgctgctagtttttatgagaagtatattatattaaatgtgaattttttaaattttgcttcttatactggaaggaattttagccttcatattgatatctaattaattatttaagtggaagaggcctgcatcacaattgaggtaatgtagagcaacatgttaaagaatgatggttagcagaagctgttgtatacaatcttcatgaaaatttcagtgtgtatttttctttttctataatacctttaactgcaaagaaaaggcagtttcaaatataagaaatttatttcaggtaagggtaatattttaatagtagtcaataatctagcttaaggctgtaactcttctatcggggctaattgtatgaataggtgtcagtatgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaa

SEQ ID NO: 119978 - DNA, 618 bp, Homo sapiens
  Payload ID: 3524
  Gene Symbol: CLDN12
  Gene Name: claudin 12
  ENST ID: ENST00000427904
  CDS Start-End: 240-618
gttccgatttctgggtcttttgcataagtaactgaggattttatgtaaaatggctaaatccaggagaatcaggagcgttggaaaacgctgaccacatctgtggatgtgaaaattgagctcagattattgctactctgtattcagatcttcatgtgtctcttctaagctgaataaagctgttttggaactgtcaggtacctcaaagctctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctgg

SEQ ID NO: 119979 - DNA, 1163 bp, Homo sapiens
  Payload ID: 3524
  Gene Symbol: CLDN12
  Gene Name: claudin 12
  ENST ID: ENST00000416322
  CDS Start-End: 637-1163
caatggtggtttcattcagagtctagtagagaacctcatgcacaaatgaggaaaagtagggtgtatgattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgctcagattattgctactctgtattcagatcttcatgtgtctcttctaagctgaataaagctgttttggaactgtcaggtacctcaaagcaacaaccctgcaaggttggcactgttattttttccatttcacagatgaagaaaacgaggcacagggaagttctgaatctggcccaaggtcagtgagctatctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgta

SEQ ID NO: 119980 - DNA, 1098 bp, Homo sapiens
  Payload ID: 3524
  Gene Symbol: CLDN12
  Gene Name: claudin 12
  Uniprot ID: P56749
  ENST ID: ENST00000496677
  CDS Start-End: 364-1098
gcggcccagtggattctgggaattgtagtcccagccatccagggcattgccgttcagggccacgggaaaacctgactgcgctcccagaagcctccggtgtacctcgctgggaacgcacttcctgggacgctgagagggagacgctccaagaggctcctcagtgtgggcgagtaaaatgccctgcgtgtgagaagcaggctcagattattgctactctgtattcagatcttcatgtgtctcttctaagctgaataaagctgttttggaactgtcaggtacctcaaagcatgaagaaaacgaggcacagggaagttctgaatctggcccaagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctggacctgcgtgtcctccagtttgccctacccctcagcatgctgatcgccatgggtgccctgctgctctgcctgattggaatgtgcaacactgccttcaggtcctcggtgcccaacatcaaactggccaagtgtctggtcaatagtgcaggttgccacctggtggctgggctgctatttttcctggcaggtactgtgagcctctccccatctatctgggtcatcttttataacatccatctgaacaagaagtttgagccagtcttttcatttgactatgcagtgtatgtcactattgctagtgctgggggcctgtttatgacttcccttatactatttatttggtattgtacatgcaaatctttgccttctcctttctggcaaccattgtactcccatccacccagtatgcatacttactcacagccctattcagcacgctctcgcctctctgccattgaaattgacattccagtagtttcacacaccacttaa

SEQ ID NO: 119981 - DNA, 1453 bp, Homo sapiens
  Payload ID: 3525
  Gene Symbol: CLDN14
  Gene Name: claudin 14
  Uniprot ID: O95500
  ENST ID: ENST00000342108
  CDS Start-End: 379-1098
ggggagggcaagctgggaaaagctgagagaggcaggcagcccagccaggcagaagtcacgagccaggcacctgccaagagagggagtaagatgttcaagaggagctccggaagaactttcagatatagcactggacttggctgaggacacagcagcacggggctgcaaggcccagagatctggacacaagccaagaagtcaagaactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 119982 - DNA, 1752 bp, Homo sapiens
  Payload ID: 3525
  Gene Symbol: CLDN14
  Gene Name: claudin 14
  Uniprot ID: O95500
  ENST ID: ENST00000399135
  CDS Start-End: 678-1397
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccattctaaggaacactgtaattgtctagacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 119983 - DNA, 1330 bp, Homo sapiens
  Payload ID: 3525
  Gene Symbol: CLDN14
  Gene Name: claudin 14
  Uniprot ID: O95500
  ENST ID: ENST00000399136
  CDS Start-End: 256-975
agcggccatgagctggtgtgcagccgcccaggaggggggctgcaaggcccagagatctggacacaagccaagaagtcaagaactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 119984 - DNA, 1942 bp, Homo sapiens
  Payload ID: 3525
  Gene Symbol: CLDN14
  Gene Name: claudin 14
  Uniprot ID: O95500
  ENST ID: ENST00000399137
  CDS Start-End: 868-1587
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccattctaaggaacactgtaattgtctagacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatgcctggaagtgcacatgctcatctacagctttcttggaagaagaaagaaacaaaaactgagatttagaacaccaggtctgtttccactggcggccactcttgggcactggagaccagcaagagctttgtttttaaaaggctcttccatggcagatattcgcagaggcatcagggctacacttaaatgaagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 119985 - DNA, 1231 bp, Homo sapiens
  Payload ID: 3525
  Gene Symbol: CLDN14
  Gene Name: claudin 14
  Uniprot ID: O95500
  ENST ID: ENST00000399139
  CDS Start-End: 157-876
tgtaaagaggatgtgtttgcttcaccttctgccaggattgtaagtttcctgaggcctccccagtcctgcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 119986 - DNA, 1370 bp, Homo sapiens
  Payload ID: 3526
  Gene Symbol: CLDN15
  Gene Name: claudin 15
  Uniprot ID: P56746
  ENST ID: ENST00000308344
  CDS Start-End: 366-1052
ggctccagggtaagtctgccccccccaccctcgtggggcggggagcccggggcagcccagaggctggggggagggggtggacttttggcccgtttcggttattccctccatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttca

SEQ ID NO: 119987 - DNA, 2131 bp, Homo sapiens
  Payload ID: 3526
  Gene Symbol: CLDN15
  Gene Name: claudin 15
  Uniprot ID: P56746
  ENST ID: ENST00000401528
  CDS Start-End: 1127-1813
ctgcactggctcgggatggggaccagaggctgctaatccatcatcattaacgaatagagtgggtgacagtccctgataactgggaacaggttgcagagcttagccacaggatcacgctccaggctgttggccagcaggaccaggctcgatgctgagtcaaagatcaacttaggaggaaatttgagttttgggtgagagcgactccctggtggcctcagccctgtgacactcacatccaggacagttcccggtgccaagcgctggttatgtgtggggggcttgactccctggtcccaacgaggtctcagtgtgttgcccaggctggtcttgaactcctgagttcaagcaatcgtctcagcccagcctcccaaagtggtaggattacaggcgagagccactgcgcccggcccctggtcccagttctcaccacagcccctgcagtaagcagtcgggtatgtcactgacagagcagaagctcaggggactaaaactccccgcctgagttccctggtgaatggatggtggggccgagttccattccaggctggatggagcccagagctgtgggtctcctaccctcccatcccctcattccagcttgatcttccttaagagactcatacgccccaaccccttggtctgagtatcttagattgttctcgtggttcctccgtccttcaccactgaaggctgctgttcattctctctccgtctctgtcccttattgctctcacgtctgtctctgtcatcttttcactccttgtccctcttactccgttctttggcccccaatgaaagctgagtcagagacagacgcttcccctcagttcccagtgcctcccttgggggcccctccttggctgtatccgtcagtggctccaggctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttca

SEQ ID NO: 119988 - DNA, 691 bp, Homo sapiens
  Payload ID: 3526
  Gene Symbol: CLDN15
  Gene Name: claudin 15
  ENST ID: ENST00000412417
  CDS Start-End: 180-691
gagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccag

SEQ ID NO: 119989 - DNA, 632 bp, Homo sapiens
  Payload ID: 3526
  Gene Symbol: CLDN15
  Gene Name: claudin 15
  ENST ID: ENST00000414035
  CDS Start-End: 189-632
acagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtg

SEQ ID NO: 119990 - DNA, 832 bp, Homo sapiens
  Payload ID: 3526
  Gene Symbol: CLDN15
  Gene Name: claudin 15
  ENST ID: ENST00000433833
  CDS Start-End: 1-319
cgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttgagctcccagtaggggctggccacggccaggtgtgggagggacttcgaagataagagtgagcggctgcctccgggagcttacatcctagctggggagcagagttagggtgcacgctatggcgcacacacacagtgcacgtccacagtgccataccacggggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagct

SEQ ID NO: 119991 - DNA, 1509 bp, Homo sapiens
  Payload ID: 3526
  Gene Symbol: CLDN15
  Gene Name: claudin 15
  ENST ID: ENST00000611078
  CDS Start-End: 366-752
ggctccagggtaagtctgccccccccaccctcgtggggcggggagcccggggcagcccagaggctggggggagggggtggacttttggcccgtttcggttattccctccatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttc

SEQ ID NO: 119992 - DNA, 3273 bp, Homo sapiens
  Payload ID: 3527
  Gene Symbol: CLDN16
  Gene Name: claudin 16
  Uniprot ID: Q9Y5I7
  ENST ID: ENST00000264734
  CDS Start-End: 249-1166
cttcttccgagtggggaggagaatagctcactctccctagagggcctaagaaagatcagtttacaggttccagcatggggtgggacccttcctccttcccccgtcttggcactggcacttggtctggtgaccaccactagcccacagttgggtcagaaaacgttacagaactcctctctcccccacccgaaacacactcagcccttgcactgacctgccttctgattggaggctggttgcttcggataatgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggaggtgagcacaaaatgccgaggcctctggtgggaatgcgtcacaaatgcttttgatgggattcgcacctgtgatgagtacgattccatacttgcggagcatcccttgaagctggtggtaactcgagcgttgatgattactgcagatattctagctgggtttggatttctcaccctgctccttggtcttgactgcgtgaaattcctccctgatgagccgtacattaaagtccgcatctgctttgttgctggagccacgttactaatagcaggtaccccaggaatcattggctctgtgtggtatgctgttgatgtgtatgtggaacgttctactttggttttgcacaatatatttcttggtatccaatataaatttggttggtcctgttggctcggaatggctgggtctctgggttgctttttggctggagctgttctcacctgctgcttatatctttttaaagatgttggacctgagagaaactatccttattccttgaggaaagcctattcagccgcgggtgtttccatggccaagtcatactcagcccctcgcacagagacggccaaaatgtatgctgtagacacaagggtgtaaaatgcacgtttcagggtgtgtttgcatatgatttaatcaatcagtatggttacattgataaaatagtaagtcaatccaggaacagttatttagaattcatattgaattaaattaattgctagcttaatcaaaatgtttgattctcctatactttttctttctattactcttatattttcccgtcattctctctgctaaccttccaccttatgcacacactttccctatattttaagataagtctgctaggatgtagaaatatttgtttgtgatttctatatagctattagagattatgacatagtaatattaaaatgaaatgatacttaaacagaaagcaatttccaaagaggccagggaccctaatctttgaagagatgaagaaacttacttttctccctggcttttggttcactttttgtacttttaacaagtgggtgaattatttgataattttgaggaagattattcttttaaattcaaactagtatgtcaatgcctaccattactctgattatattaaaacagaaaaaggaaataacaacttcgtataccagccactggtgagagttaaagacaagagctgcccccccacccccaaatgtcaaaggcaaatgctaaattgatactggagctcgtggtgactttctacctcactaacaacataagggatctccatattatttcaccactattctagctttgctgatatattgccaaatgattagactacagaatagttcaaccagagaatttactcatttattgattaaacatccaaatactattgtaatatactatgttaaaattcatcaattcaagtgcccacacaccactgaatcatcagcaccaagcaatatattagacatatggcaaaattcaacaaatatattttgatataaataaataaacgttcacgactttacttaaaaaatcaatgttgcggctgggcacggtagctcgcgtctgtaatccccgcactttgggaggccaaggcgggtggatcacgaggtcaagagacggagaccatcctggctaacatggtgaaaccctgtctctactaaaaatacaaaaattagccgggcgtggtggcggtgcctgtagtcccagctactcgggaggctgaggcaggagaatcgtttgaacccaggaggtggaggttgcagtgagcggagatcgcaccattgcactccagtctggcaacagagcgagactccatctcaaaaaacaaaaataaataaataaataaatattcttcataaaatgtgggttttggggaaaatatagaattacatatacatttaacgaagtcgctaatgacatttcattcatattcataatgtaaccatcttgaatttttttaattgtagcgattttaaaaatgtttgtaaaatttaatttccagttttctaattacttgtcagtcacattaataacattagtacctttatggtacccttgcagtacctgaaaagaatatcaacctgaaaagaatatcaactcacccagaaattagttctttgaaaaaaaagaaattaagttgtgaatttctaaagaccttgaaataagtgtttcaaatttaaagaacaaagaatgatgtgaaaatgagattatgattcctactacatgaattaacgtttcgagattgctgtttattacttcccagagtatctttaacagtattctctgaagcagttccaatctagttggagaattaacagcaattgatttaactatctcatttttattaactgtaatttactttaaaaatatttgcaaatcatactcattagttatttgatcattgttctatgcattttaaaattaattttgtgttgttcctctcaatatttgtttttaacatttattcccatttttattttatactattgtctgtcatgctttatgtattccaataagtgtcttgaaatccttgtggggaaaggcaggacaaaaataattagttaattagatttgaaaaatgtaatttttccattttaaatatttcatttgtataagaaaatatttcagagaaccatgatgataatggatatgtgtgactgttttgaatttttttctcaattaaaacattttgtatgtaatggga

SEQ ID NO: 119993 - DNA, 430 bp, Homo sapiens
  Payload ID: 3527
  Gene Symbol: CLDN16
  Gene Name: claudin 16
  ENST ID: ENST00000456423
  CDS Start-End: 1-360
atgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggagatgttggacctgagagaaactatccttattccttgaggaaagcctattcagccgcgggtgtttccatggccaagtcatactcagcccctcgcacagagacggccaa

SEQ ID NO: 119994 - DNA, 1193 bp, Homo sapiens
  Payload ID: 3528
  Gene Symbol: CLDN17
  Gene Name: claudin 17
  Uniprot ID: P56750
  ENST ID: ENST00000286808
  CDS Start-End: 140-814
ctgatttggactaaaacgttatgggcagcagccaaggagaacatcatcaaagacttctctagactcaaaaggcttccacgttctacatcttgagcatcttctaccactccgaattgaaccagtcttcaaagtaaaggcaatggcattttatcccttgcaaattgctgggctggttcttgggttccttggcatggtggggactcttgccacaacccttctgcctcagtggagagtatcagcttttgttggcagcaacattattgtctttgagaggctctgggaagggctctggatgaattgcatccgacaagccagggtccggttgcaatgcaagttctatagctccttgttggctctcccgcctgccctggaaacagcccgggccctcatgtgtgtggctgttgctctctccttgatcgccctgcttattggcatctgtggcatgaagcaggtccagtgcacaggctctaacgagagggccaaagcataccttctgggaacttcaggagtcctcttcatcctgacgggcatcttcgttctgattccggtgagctggacagccaatataatcatcagagatttctacaacccagccatccacataggtcagaaacgagagctgggagcagcacttttccttggctgggcaagcgctgctgtcctcttcattggagggggtctgctttgtggattttgctgctgcaacagaaagaagcaagggtacagatatccagtgcctggctaccgtgtgccacacacagataagcgaagaaatacgacaatgcttagtaagacctccaccagttatgtctaatgcctccttttggctccaagtatggactatggtcaatgttttttataaagtcctgctagaaactgtaagtatgtgaggcaggagaacttgctttatgtctagatttacattgatacgaaagtttcaatttgttactggtggtaggaatgaaaatgacttacttggacattctgacttcaggtgtattaaatgcattgactattgttggacccaatcgctgctccaattttcatattctaaattcaagtatacccataatcattagcaagtgtacaatgatggactacttattactttttgaccatcatgtattatctgataagaatctaaagttgaaattgatattctataacaataaaacatatacctattctaaaat

SEQ ID NO: 119995 - DNA, 3520 bp, Homo sapiens
  Payload ID: 3529
  Gene Symbol: CLDN18
  Gene Name: claudin 18
  Uniprot ID: P56856
  ENST ID: ENST00000183605
  CDS Start-End: 227-1012
gagcagacaagtgcctcttgggcccgcttctctaacaaatgtaaaaataatgcccttgaaccaggagcgaaactgagctatctaaggaaaacactgtgagcaaatactgagagcctagggaaaccatctgattagaagagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacgcctgtaatcctagcactttgggaggctgaggaggaaggatcacttgagcccagaagttcgagactagcctgggcaacatggagaagccctgtctctacaaaatacagagagaaaaaatcagccagtcatggtggcctacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttagcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctaca

SEQ ID NO: 119996 - DNA, 3434 bp, Homo sapiens
  Payload ID: 3529
  Gene Symbol: CLDN18
  Gene Name: claudin 18
  Uniprot ID: P56856
  ENST ID: ENST00000343735
  CDS Start-End: 135-920
aaccgcctccattacatggtccgttcctgacgtgtacaccagcctctcagagaaaactccatccctacactcggtagtctcagaattgcgctgtccacttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacgcctgtaatcctagcactttgggaggctgaggaggaaggatcacttgagcccagaagttcgagactagcctgggcaacatggagaagccctgtctctacaaaatacagagagaaaaaatcagccagtcatggtggcctacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttagcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctacagttgaa

SEQ ID NO: 119997 - DNA, 2039 bp, Homo sapiens
  Payload ID: 3529
  Gene Symbol: CLDN18
  Gene Name: claudin 18
  ENST ID: ENST00000479660
  CDS Start-End: 11-451
ggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacgcctgtaatcctagcactttgggaggctgaggaggaaggatcacttgagcccagaagttcgagactagcctgggcaacatggagaagccctgtctctacaaaatacagagagaaaaaatcagccagtcatggtggcctacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaa

SEQ ID NO: 119998 - DNA, 2859 bp, Homo sapiens
  Payload ID: 3530
  Gene Symbol: CLDN19
  Gene Name: claudin 19
  Uniprot ID: Q8N6F1
  ENST ID: ENST00000296387
  CDS Start-End: 192-866
attctggagtccagagccactgcctttgctccagccgctgccgccgcaccacctctccttctctgcctctgaccctccttctcgctgctccccctgcccagctgctcctcccacctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagaaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctaagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcac

SEQ ID NO: 119999 - DNA, 1586 bp, Homo sapiens
  Payload ID: 3530
  Gene Symbol: CLDN19
  Gene Name: claudin 19
  Uniprot ID: Q8N6F1
  ENST ID: ENST00000372539
  CDS Start-End: 78-713
ctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagctcactccactaaccagctctctctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaa

SEQ ID NO: 120000 - DNA, 3517 bp, Homo sapiens
  Payload ID: 3530
  Gene Symbol: CLDN19
  Gene Name: claudin 19
  Uniprot ID: Q8N6F1
  ENST ID: ENST00000539749
  CDS Start-End: 192-848
attctggagtccagagccactgcctttgctccagccgctgccgccgcaccacctctccttctctgcctctgaccctccttctcgctgctccccctgcccagctgctcctcccacctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagctcactccactaaccagctctctctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctaagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcac

SEQ ID NO: 120001 - DNA, 2959 bp, Homo sapiens
  Payload ID: 3531
  Gene Symbol: CLDN2
  Gene Name: claudin 2
  Uniprot ID: P57739
  ENST ID: ENST00000336803
  CDS Start-End: 327-1019
agatggattttgcaaagctgtggttaacgattagaaatcctttatcacctcagcccgtggccccttgtacttcgctcccctccctcaggatccctttctccctctccaggggcatctccccctccaaggctctgcaaagaactgccctgtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 120002 - DNA, 3150 bp, Homo sapiens
  Payload ID: 3531
  Gene Symbol: CLDN2
  Gene Name: claudin 2
  Uniprot ID: P57739
  ENST ID: ENST00000541806
  CDS Start-End: 520-1212
cccagagcaagccgattctctacacactgccttcccttcctgtaagactcatcaaaaaggcaccccaaccttgcatggatctgctgttggtattccttggggtgaagccagaagtcaggctttccacagagagacgggactacatggccacctgggaaggctagggagtcaaagggcctgaggaatgactacttccctccacaagggcattccctgccctgctctgcttcctgggggcttcagcaagccttccttctagagctcctagaaccctcccatggtcaacacaacagcagcccagacaatgagatgcaagaggcctgagctcacaggccattcaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 120003 - DNA, 2919 bp, Homo sapiens
  Payload ID: 3531
  Gene Symbol: CLDN2
  Gene Name: claudin 2
  Uniprot ID: P57739
  ENST ID: ENST00000540876
  CDS Start-End: 289-981
aggcatggctgcccttttagcgtgtcccagcctgccaagagggagtgccctggagagacccttgctcaggagcactgccaggggatcagtgccccatttgtacctgcaaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattg

SEQ ID NO: 120004 - DNA, 1209 bp, Homo sapiens
  Payload ID: 3532
  Gene Symbol: CLDN20
  Gene Name: claudin 20
  Uniprot ID: P56880
  ENST ID: ENST00000367165
  CDS Start-End: 381-1040
aaagttcgaagtgggatgatcacgggcagacctgggtggttgggaacaggaagcatatggcatcttgcaggctataggcaccacaaaatggaacgcaggaggacaggggcttgggagagccacttcactgtcgggtaaaacaacggagcaagatgagtgcctccggatgcttggtttccccaccctccagtgtctgcttgctcttcaagtacctccaccaagctaatgacagtccactttaggacatcacgggcctcgaggttacaactttcccaggctttgttatttggttctctactgcacagaaatagatagaattctgacagccatcattgttaaacatcaggattttctaagaggacagacttaacagtaacatcatggcctcagcaggactccagctccttgctttcatcctggccttatctggggtctctggagtgctcacagccactctgctgcccaactggaaggtgaatgtggatgtggactccaacatcataacagccattgtacagctgcacgggctctggatggactgtacgtggtacagcactgggatgttcagctgtgccctgaaacactccattctgtccctccccatccacgtgcaggctgcgagagccaccatggtcctggcgtgtgttctgtctgctttggggatctgcacttccacagtaggaatgaaatgtactcgcttaggaggggacagagaaaccaagagccatgcttcctttgctggaggagtctgtttcatgtctgcaggaatctctagtttaatctcgacagtgtggtacacaaaggagatcatagcaaactttctggatctgacagttccagaaagcaacaaacatgaacctggaggagctatctatatcggattcatttctgcaatgctgttgtttatctctggcatgattttctgcacctcctgtataaaaaggaatccagaagctagactcgacccacccacacagcagcctatctctaacacacagctcgagaacaattccacacacaatctgaaggattatgtgtaaataactgagtaatgcatatgaaatggaacttttgggtgccaaatgggacttttagattaaaaaaaaatcagaattatgcttaactttccctacaaagaaagtagaatgtaaaatactttaacaactacaaagtagtttaaaatgccaataaaactatcatatacaatta

SEQ ID NO: 120005 - DNA, 2581 bp, Homo sapiens
  Payload ID: 3533
  Gene Symbol: CLDN22
  Gene Name: claudin 22
  Uniprot ID: Q8N7P3
  ENST ID: ENST00000323319
  CDS Start-End: 557-1219
ctgataagattgatttatttggttaagaaatacttttcttaaacctatttttaaaaaataacactcagtattaccataacatgcacatttgaaatgtgagaactataagagatgaaaatctgacaggtgcagttagtgaaacacaaagcaggaggagttgaaccaaaaccatcagttaaacattttgcatttagacttaattctttgttagaaaggttgggaataacatgaaagccattttaaccttgacaatgaaaggagattatcacttaattatatttcagtgacaaactgctttctgtcaaatccagcccacaggacacaaacacaatcttggccacaccttggcattactggttggcggcattatttccctatccttttgtgaaacccattcaacatggaatcaaacaatagcaactctggcaagaatcctcctatatacacaatgaagaaatatttctgagtttcataagttataacacaagtgtcacacttcttttcacagcaaccgaagggcaggagttagtttggctaaagctctcaggacattataatggctttagtatttagaactgtagctcaactagctggagtttcattatctttgctgggatgggttttatcctgtcttacaaactacctgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctgatcctgggaggaattctgtcctgggcctcgggagtcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctccactgtgcagcctgctccagccacgctcccctagcttcgggccactacgcagtggcacaaacacaagatcatcatcaagaactggagacgagaaacaccaacctgaaacactaagccagaaaggacaagcgtctgctgttcaggagacgcttgctcaacactggatttggtaggatgtcccgctctagtcatctcactgtgcttttgatttttgaaaatgcatcttttcctgtggctattaaactatagtttctttccaagactggtaaaccatttttatcttctagtctgagaccaaaatcaatcaagactgaatagtaatgacacccattactgtggatgagttttctcaattttaaaatagcgattgcacagaagtggtaaataaaacattaatctctatgtatctttgaaggtattattcatatggagcggaatcatttggcaaatcatttacttatttcaggtgtttaagataacctagtataataagcctgaggtcttgttgcatatttatttaaaatgcatgacgtcttattatataaaataattactagctctttagaagcttcagaggtgaaaggtgtagacacatcatctccttctgaatcagagacctcagtgtctctatggaacctttttcaaaaggcagccacattcagtcacgccttctatactgtcagaggcaggagggcgatcttgggttttggatgattcaagtagactctgccacacaaacgtgcttctgcatcctgtgttctgtatttcacgggcagcgtttctggcttcccaggcactgagcagcctgtggggggcacggcagggcaggactggggtgtgtgggtagataacctcctgggacggctgcctctctgtggagcacactgccagcccaggcgcagcgaccacagagcacatattctggagcccttcattttatttgctcaatgaaaatacttcgtccttttttatcagcaatacatatagttccaacaagaactattcatcacaaactgccagcctggggatttcttcatgaaatattttgtatttgcttggtacatggttcaaggaaactcttgtgtttgtgccaatcagggaaataaactgaacaataaacgacactgaaatagagtattaggcaatatgtagctttgtttttgcttttttttttaaaaaaaaccactgaatttttttccacccacaaacacatggaaagtgcagaaaccagttaatctatgtgatgtatttgcatacgtttacaaacaagacaaattaaaacagaaacatgttcagaatttaacctgattaaatattaagttcagtcctgagcttttgatatttaagacaatatagataaagcaatagcaaaaaattttaatttatttgatttgcatgctacagagatttagctaaactttgttcatttggctagcaatattctttttgtacctgtaacacttaagattctgatat

SEQ ID NO: 120006 - DNA, 2169 bp, Homo sapiens
  Payload ID: 3534
  Gene Symbol: CLDN23
  Gene Name: claudin 23
  Uniprot ID: Q96B33
  ENST ID: ENST00000519106
  CDS Start-End: 462-1340
ggcgtggcccagccgcccggctgcaaggtggggtgtccccgccgctcggatccccatctcacctgccgcgggcgaggtggccccgccgcttcctgcgctcacctcgggtccctccctcccgggccaggtttggccgcggcagccgcccctgggcgcccgcgcccggacccgcggtttcggtcagacccgcccgcgggctggtttcgattagggccagtaggagggcggagcggccgggacgccaggagggaactagcctaagtggggacggtccccgtgcaggagacaaagagcgtccctggagcgatcagggctcaggagcccgacccggagcccggggcgtccgcgctgacttcgggtccccggagcctggggcacggcagggagaagacgacggcggagaaggcgacagcggagaaggaaggcaggctgcaggggcgccgtcggcgcggcgggccgggatgcggacgccggtggtgatgacgctgggcatggtgttggcgccctgcgggctcctgctcaacctgaccggcaccctggcgcccggctggcggctggtgaagggcttcctgaaccagccagtggacgtggagttgtaccagggcctgtgggacatgtgtcgcgagcagagcagccgcgagcgcgagtgcggccagacggaccagtggggctacttcgaggcccagcccgtgctggtggcgcgggcactcatggtcacctcgctggccgccacggtcctggggcttctgctggcgtcgctgggcgtgcgctgctggcaggacgagcccaacttcgtgctggcagggctctcgggcgtcgtgctcttcgtcgctggcctcctcggcctcatcccggtgtcctggtacaaccacttcttgggggaccgcgacgtgctgcccgccccggccagcccggtcacggtgcaggtcagctacagcctggtcctgggctacctgggcagctgcctcctgctgctgggcggcttctcgctggcgctcagcttcgcgccctggtgcgacgagcgttgtcgccgccgccgcaagggaccctccgccgggcctcgccgcagcagcgtcagcaccatccaagtggagtggcccgagcccgacctggcgcccgccatcaagtactacagcgacggccagcaccgaccgccgcctgcccagcaccgcaagcccaagcccaagcccaaggtcggcttccccatgccgcggccgcggcccaaggcctacaccaactcggtggacgtcctcgacggggaggggtgggagtcccaggacgctccctcgtgcagcacccacccctgcgacagctcgctgccctgcgactccgacctctagacgcttgtagagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatatatttttgctgaagaatatatggaaagggtggcatttgcgtcacgtggaccagggacagtgctgaaatcagcagtgctcagaaacaatttaacatgttgaaacgacaatattctaaaatactgatgaatcttgcatcaatataattattgggttttttttctttttcctgctgtataactccttgccatgcaaactctcaagaggccaatatattcctggccatgtttgaatgagcctcttaaaataaacttagagccatgcaaatgccagcagcttaatggatttcatggaatgaaataccgtgattaactcatagctacatatcattgcataaatgggatttatcttttttctcacttatttttgcggtgaaagtcgagggcatgcaagagtttctcttccagaagccaagaggagaacaaaggtcctaatgctgtactattccaccctttggacgcctcatccaggacgcagaggactctaggtttaacattttgtacaaaatggaacctgttaatcatattaaagcacatatgtatatatcttttatttataaataaaattttaaaacaatagtttcagtat

SEQ ID NO: 120007 - DNA, 597 bp, Homo sapiens
  Payload ID: 3535
  Gene Symbol: CLDN24
  Gene Name: claudin 24
  ENST ID: ENST00000514470
  CDS Start-End: 7-597
acagcaatgcaatctgttggacttttactatctctcctgggatggattttatccattattacaacttatttgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctcattctgggaggaattctgtcctgggcctcgggaatcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctcaactgcgcagcctgctccagccacgctcccctagctttgggccactatgcagtggcgcaaatgcaa

SEQ ID NO: 120008 - DNA, 663 bp, Homo sapiens
  Payload ID: 3535
  Gene Symbol: CLDN24
  Gene Name: claudin 24
  Uniprot ID: A6NM45
  ENST ID: ENST00000541814
  CDS Start-End: 1-663
atggctttaatctttagaacagcaatgcaatctgttggacttttactatctctcctgggatggattttatccattattacaacttatttgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctcattctgggaggaattctgtcctgggcctcgggaatcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctcaactgcgcagcctgctccagccacgctcccctagctttgggccactatgcagtggcgcaaatgcaaactcagtgtccctacctggaagatgggacagcagatcctcaagtgtaa

SEQ ID NO: 120009 - DNA, 754 bp, Homo sapiens
  Payload ID: 3536
  Gene Symbol: CLDN25
  Gene Name: claudin 25
  Uniprot ID: C9JDP6
  ENST ID: ENST00000453129
  CDS Start-End: 50-739
ctgacccactcgtgctccttttctttctgcatctgtggtgggagtgactatggcctggagtttccgtgcaaaagtccagctcggggggctacttctctccctccttggctgggtctgctcctgtgttaccaccatcctgccccagtggaagactcttaatctggaactgaacgagatggagacctggatcatggggatttgggaggtctgcgtggatcgagaggaagtcgccactgtgtgcaaggcctttgaatccttcttgtctctgccccaggagctccaggtagcccgcatcctcatggtagcctcccatgggctgggcctattggggcttttgctctgcagctttgggtctgaatgcttccagtttcacaggatcagatgggtattcaagaggcggcttggtctcctgggaaggactttggaggcatccgcttcagccactaccctccttccagtctcctgggtggcccatgccacaatccaagacttctgggatgacagcatccctgacatcatacctcggtgggagtttggaggtgccctctacttgggctgggctgctggtattttcctggctcttggtgggctactcctcatcttctcggcctgcctgggaaaagaagatgtgccttttcctttgatggctggtcccacagtccccctatcctgtgctccagtggaggagtcagatggctccttccacctcatgctaagacctaggaacctggtcatctaggactggcttctgcca

SEQ ID NO: 120010 - DNA, 1274 bp, Homo sapiens
  Payload ID: 3537
  Gene Symbol: CLDN3
  Gene Name: claudin 3
  Uniprot ID: O15551
  ENST ID: ENST00000395145
  CDS Start-End: 222-884
agcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 120011 - DNA, 995 bp, Homo sapiens
  Payload ID: 3538
  Gene Symbol: CLDN34
  Gene Name: claudin 34
  Uniprot ID: H7C241
  ENST ID: ENST00000445307
  CDS Start-End: 1-645
atggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtcccccgtacggccaagtgcatcctggtatttcagaaatgtgaatttcctggttgcattggctttgcaaatctaagatttctgggagtttatggaaaatgttattagcatgctctaccaaatatttccaacgactcaagaccgtggcatgggtagtttgggacagaaggtggccaactgcctccttctgttatcttgtgtatctgaatgtggctcactgatttgttggttgaattgagaacttttatttaaaagtcttcccacctgccagttggtcttattgcatctgaattttaattattgttggctacagcaaataatcaaccctgtaaactaagagtagggaaataagagtttctgagtacattaacttctcacatttccctcttaaact

SEQ ID NO: 120012 - DNA, 1831 bp, Homo sapiens
  Payload ID: 3539
  Gene Symbol: CLDN4
  Gene Name: claudin 4
  Uniprot ID: O14493
  ENST ID: ENST00000340958
  CDS Start-End: 340-969
aaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaggaaattt

SEQ ID NO: 120013 - DNA, 4108 bp, Homo sapiens
  Payload ID: 3539
  Gene Symbol: CLDN4
  Gene Name: claudin 4
  Uniprot ID: O14493
  ENST ID: ENST00000431918
  CDS Start-End: 2627-3256
aaggctacctggctgggaccacagatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacag

SEQ ID NO: 120014 - DNA, 4163 bp, Homo sapiens
  Payload ID: 3539
  Gene Symbol: CLDN4
  Gene Name: claudin 4
  Uniprot ID: O14493
  ENST ID: ENST00000435050
  CDS Start-End: 2681-3310
cacttgtgctgagctactggctgatccccaaggacatccttctggcctctccttcacacctgggtcccctagccctgcatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 120015 - DNA, 2357 bp, Homo sapiens
  Payload ID: 3540
  Gene Symbol: CLDN5
  Gene Name: claudin 5
  ENST ID: ENST00000403084
  CDS Start-End: 874-1785
atcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagaggtctgggaagcccctgcggcttgggagagtgggggtcgccaggcagggggaaagcccctgtgccaccgctttttgccagagactcaggctccagagaggcagtgagtggcatggggggtgaggctggggccctgggcctgacctccacacgcctgcctggcctctctgtttgccatgggatgagagagacagtgctgggactcagagcggggctggagagtgagagtgcgagaaagggcctgggtggggcttggaccccggggcgggctttctggagagcccccctacgagggcctctacggcggtgacggggtggggggcttctgcaaaccttggtcagggaagtggagctggctcgagtggaagagaccacccggctcagtcggggatgtgggagtggactgggtggtgcagactgggggtcgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 120016 - DNA, 2548 bp, Homo sapiens
  Payload ID: 3540
  Gene Symbol: CLDN5
  Gene Name: claudin 5
  ENST ID: ENST00000406028
  CDS Start-End: 1062-1973
aaagcagaacaatggctgggggtgagcaggtggccttggccagtgctctgccccaagggccctttaccagagatcaggggtttgtgtccctgcctaaccaggacacctccgatctccacctgcaggccctggaccactgtggcactgtggacacaaggccgcttctgccccttggacgccgagccccttcccacctctgggatcttgcactggctattgcttctgctctgcctggaacttcttccccggatccctgtgaaatgtcacctcttcagagaggccttcaccactgtctttcctgcccagttcttggttgataggttcctgtcagctccttctgggcaggagcttcttgtgctgtgtgctctgcctagagacagtgcttgccacgaagtaggtgagcagaccctccatgagtggcaggaaaggtgggtgcaccctcatgcccctccggagtctggcctgggctactcagaggccagcctccatctgaggtgggtttgtctggggtggcgtcagcccctgcggccctctctgggcctctctgcattggcattgttccactgcagcctggggcctcgaccaacatagtggggtcagggtagaaaccagattgtgaaaggtgaagcctgagactcctctgccacgtccctgagatgctgtgaggctgccgccaaagaaacatgagcttgctggggccaccctagggtgacagctaggagagaagaaaaacaggcagccaggtgagaagggagagccttgggctggctgcagctccaagctggctagagggcaacaggcagcctcctgtgcaggacagacgcatgaagacagccaccctgtggaggttattcctggatactaggtgggaaagtcggcaagcaaaaggacaggtccagctcaagcttctaaaagcaatgctgggggacggtgcagcaaggtgttcctggaaatgacctcggcaacacatcttagaagatgagcaggacccaacctgacagatacacgctgcgggcagaagaggccaagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctctcc

SEQ ID NO: 120017 - DNA, 1760 bp, Homo sapiens
  Payload ID: 3540
  Gene Symbol: CLDN5
  Gene Name: claudin 5
  ENST ID: ENST00000413119
  CDS Start-End: 302-1213
ttccggagggtggcctgggggctggggtgccagggacaccatcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatc

SEQ ID NO: 120018 - DNA, 1374 bp, Homo sapiens
  Payload ID: 3540
  Gene Symbol: CLDN5
  Gene Name: claudin 5
  Uniprot ID: O00501
  ENST ID: ENST00000618236
  CDS Start-End: 146-802
ggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 120019 - DNA, 1369 bp, Homo sapiens
  Payload ID: 3541
  Gene Symbol: CLDN6
  Gene Name: claudin 6
  Uniprot ID: P56747
  ENST ID: ENST00000328796
  CDS Start-End: 61-723
cgacactcggcctaggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgc

SEQ ID NO: 120020 - DNA, 1739 bp, Homo sapiens
  Payload ID: 3541
  Gene Symbol: CLDN6
  Gene Name: claudin 6
  Uniprot ID: P56747
  ENST ID: ENST00000396925
  CDS Start-End: 430-1092
cgaacggccggacgcggtggctcacgcctttaatcccatcagtttgggagtctgaggcaggcggattacgagagtaggaaacgaaggctcgggaaggttaggtgagttccccatgtcaccgcgctgcttaagtggtgaagcggagtctcaagctctgttctaccctaagcctggcgccctcaccctgggtgagtctggacgtctgccagcccgaggcgggcccagcgaccccagcctccagcgcccccctctgacaagcctgggattcgcacgcccgctgccgtcagggacagggtctctgcccctcctccggggcggtggtccagtgacgtcaccgcttctttaagacccccgcctccgcccctgtcccgacactcggcctaggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccatcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgca

SEQ ID NO: 120021 - DNA, 461 bp, Homo sapiens
  Payload ID: 3541
  Gene Symbol: CLDN6
  Gene Name: claudin 6
  ENST ID: ENST00000572154
  CDS Start-End: 44-163
atttcccttatctccttcgcagtgcagctccttcaacctcgccatggcctctgccggaatgcagatcctgggagtcgtcctgacactgctgggctgggtgaatggcctggtctcctgtgccctgcccatgtggaaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctg

SEQ ID NO: 120022 - DNA, 1542 bp, Homo sapiens
  Payload ID: 3542
  Gene Symbol: CLDN7
  Gene Name: claudin 7
  Uniprot ID: O95471
  ENST ID: ENST00000360325
  CDS Start-End: 436-1071
gcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggta

SEQ ID NO: 120023 - DNA, 1228 bp, Homo sapiens
  Payload ID: 3542
  Gene Symbol: CLDN7
  Gene Name: claudin 7
  Uniprot ID: O95471
  ENST ID: ENST00000397317
  CDS Start-End: 356-991
aggtcccagtggtttcttcctccagttaggagccttgatgccggaggggacagtgggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagc

SEQ ID NO: 120024 - DNA, 1923 bp, Homo sapiens
  Payload ID: 3542
  Gene Symbol: CLDN7
  Gene Name: claudin 7
  ENST ID: ENST00000538261
  CDS Start-End: 903-1340
ggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggt

SEQ ID NO: 120025 - DNA, 485 bp, Homo sapiens
  Payload ID: 3542
  Gene Symbol: CLDN7
  Gene Name: claudin 7
  ENST ID: ENST00000574070
  CDS Start-End: 187-485
ccgcttggcccaggtcttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctc

SEQ ID NO: 120026 - DNA, 605 bp, Homo sapiens
  Payload ID: 3542
  Gene Symbol: CLDN7
  Gene Name: claudin 7
  ENST ID: ENST00000575313
  CDS Start-End: 25-605
ttcttcctccagttaggagccttgatgccggaggggacagtgggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccct

SEQ ID NO: 120027 - DNA, 735 bp, Homo sapiens
  Payload ID: 3542
  Gene Symbol: CLDN7
  Gene Name: claudin 7
  ENST ID: ENST00000571881
  CDS Start-End: 301-723
ggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccc

SEQ ID NO: 120028 - DNA, 743 bp, Homo sapiens
  Payload ID: 3542
  Gene Symbol: CLDN7
  Gene Name: claudin 7
  ENST ID: ENST00000571932
  CDS Start-End: 356-743
agaaagattaattgctgatgctgggttccaaggagactggagacaaggcgcaaagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcag

SEQ ID NO: 120029 - DNA, 2068 bp, Homo sapiens
  Payload ID: 3543
  Gene Symbol: CLDN8
  Gene Name: claudin 8
  Uniprot ID: P56748
  ENST ID: ENST00000399899
  CDS Start-End: 149-826
agcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttga

SEQ ID NO: 120030 - DNA, 2050 bp, Homo sapiens
  Payload ID: 3544
  Gene Symbol: CLDN9
  Gene Name: claudin 9
  Uniprot ID: O95484
  ENST ID: ENST00000445369
  CDS Start-End: 908-1561
cagattccagagagtcccaggcgggcgggagtgtgcgatactcggggagctggggcatgtttgcatcacgaaactcggctgggggagagcagaggcagctggggaggggctgcggaaggaggaggctcaggaaggcaagccgacgccccctgtgtgtgtttctgtcctgagcctgttacttttttgacccccgatccgtctcttcttcctcagcttgtcctccatcttcccctcctttacccttggttcccacatgcacagatgctacggacgcttttcctcccctgtccccactcagccgcagcatcccccgctggcccccaggcccctcatccatccgctgcccacgaacccccagccccgcaccctccccgtggctcaggtctcccctatcccggcctccctgcacttcactctgctcctcccctgcctgggccttaaaaccccgcctgcagccgagagcccgcagagtccccaggtggcactgtcagagtcgctcagtgggaacctgcgccagccggcaggagacgtggctgtcctcagcctggcagtgcgtctggagggcctgtgcgagctcagcccaggtgtgacagcggggtggtaagagcagcagcaccctcagggcatccgatgggcggaggcccctcgaggtgacacccaccactcagccgagcgggactacgagtctgctttgtgctccgcgaggaccagaaacacctgcaagaggcacggagaggaggcgcctttcaagaggcgcctttcatggaactgaggactggcctggcttggggacaccaacaagccttccccctcctgctggacacagagacacccacccagcacaccagacacaccctctgagtcacctaggccgcctggggctgagaagacctaaccgaggggccagatggcttcgaccggcttagaactgctgggcatgaccctggctgtgctgggctggctggggaccctggtgtcctgcgccctgcccctgtggaaggtgaccgccttcatcggcaacagcatcgtggtggcccaggtggtgtgggagggcctgtggatgtcctgcgtggtgcagagcacgggccagatgcagtgcaaggtgtacgactcactgctggctctgccgcaggacctgcaggccgcacgtgccctctgtgtcattgccctcctgctggccctgcttggcctcctggtggccatcacaggtgcccagtgtaccacgtgtgtggaggacgaaggtgccaaggcccgtatcgtgctcaccgcgggggtcatcctcctcctcgccggcatcctggtgctcatccctgtgtgctggacggcgcacgccatcatccaggacttctacaaccccctggtggctgaggccctcaagcgggagctgggggcctccctctacctgggctgggcggcggctgcactgcttatgctgggcggggggctcctctgctgcacgtgccccccgccccaggtcgagcggccccgcggacctcggctgggctactccatcccctcccgctcgggtgcatctggactggacaagagggactacgtgtgaggcggaggtttcccctgggagcccactgctccccactgccccgccctttcgaccttggcctgatgaccagatgccctgctccatcacaacctccttccccaggaaaacccactttccaaaagcccaagctacacctggctgcagggctgggtcagctggcctggctgagctcttctcagtggggtcccctttgatgttctcccccaagttgggcagcctagaggtgttgggaaccctggcctgcccccacctccccagtaattgtttccttccgttgcccaggacactggctggccttccttctcttctgagccctcccctgccccaggaaccctggcctcaccaaaacagcagcagctcgttggctccaaaaccagggagcagaccatgccctcccaaccctggagttgtcagggagggcctgcccatcacctccctctccccaacatccccaccctcgagttggaaataaagagcatttgtaactgg

SEQ ID NO: 120031 - DNA, 2161 bp, Homo sapiens
  Payload ID: 3545
  Gene Symbol: CLDND1
  Gene Name: claudin domain containing 1
  Uniprot ID: Q9NY35
  ENST ID: ENST00000341181
  CDS Start-End: 214-975
agtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgta

SEQ ID NO: 120032 - DNA, 2228 bp, Homo sapiens
  Payload ID: 3545
  Gene Symbol: CLDND1
  Gene Name: claudin domain containing 1
  Uniprot ID: Q9NY35
  ENST ID: ENST00000394180
  CDS Start-End: 288-1049
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactc

SEQ ID NO: 120033 - DNA, 2170 bp, Homo sapiens
  Payload ID: 3545
  Gene Symbol: CLDND1
  Gene Name: claudin domain containing 1
  ENST ID: ENST00000394181
  CDS Start-End: 164-994
aaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 120034 - DNA, 2159 bp, Homo sapiens
  Payload ID: 3545
  Gene Symbol: CLDND1
  Gene Name: claudin domain containing 1
  Uniprot ID: Q9NY35
  ENST ID: ENST00000394185
  CDS Start-End: 222-983
ggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 120035 - DNA, 865 bp, Homo sapiens
  Payload ID: 3545
  Gene Symbol: CLDND1
  Gene Name: claudin domain containing 1
  ENST ID: ENST00000502299
  CDS Start-End: 148-865
aagtgcgtcagaggaggcgcggggagagtagggtgctgtggtctgagctagagggtgaagctggcggagcaggaggatgggcgtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacacca

SEQ ID NO: 120036 - DNA, 2818 bp, Homo sapiens
  Payload ID: 3545
  Gene Symbol: CLDND1
  Gene Name: claudin domain containing 1
  Uniprot ID: Q9NY35
  ENST ID: ENST00000503004
  CDS Start-End: 881-1642
gggatttttaaaaaatcaaaatacaaatccaactttttgagttttcgttgtcattgctcttatctttcctgagtcacttcccattttccaaactcagcaaccccagtttgcgagtctgttttcatgaacctttgtaaggtgtttggtgcggtcacggtgtatacttgccgtgtagtatttgactcagcgcgatctgccttgagtcattttaccgcggccatttactactgccgttgagccctgtccacgccttgggagtgttgatatgttgagagttttctgtctggctgaggagggatcatttagtttttgcggacgtatgttgcactgaggatttagggagagagcaagatttctgttgaggaggttcagaagtataaggaatcgggagagtagataggagtgaagcatttggcagcgtaaagaagcttggcttagctttaatggattagggagagattgctatctagcattattacatgttattgttctctttgctattttatacacctagaacaacctttccctcggggttaacaaacatcttcaactctgttttctgtatggctcctgactcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 120037 - DNA, 916 bp, Homo sapiens
  Payload ID: 3545
  Gene Symbol: CLDND1
  Gene Name: claudin domain containing 1
  ENST ID: ENST00000508902
  CDS Start-End: 207-916
tctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgc

SEQ ID NO: 120038 - DNA, 750 bp, Homo sapiens
  Payload ID: 3545
  Gene Symbol: CLDND1
  Gene Name: claudin domain containing 1
  ENST ID: ENST00000506885
  CDS Start-End: 1-468
aaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagaga

SEQ ID NO: 120039 - DNA, 1380 bp, Homo sapiens
  Payload ID: 3545
  Gene Symbol: CLDND1
  Gene Name: claudin domain containing 1
  ENST ID: ENST00000507874
  CDS Start-End: 159-791
agaggaggcgcggggagagtagggtgctgtggtctgagctagagggtgaagctggcggagcaggaggatgggcgtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagtgacaaaggagagcatgcttccagctggagctgagtccaagcacacagccactcctgcacacgcatgcgtgcaaacagggaagcccaagtaggagaagaggaaagaggttgtagggatttgggaagaaccttgattattccctggaggaaaagacaaatctacttccctgaaatcaccctcgaatctacttccaccctcagaacttaaaatgaactgcatcctttttttcatcttcttttcttctccagtgaatatgatctccaaacccttattttttctttgaactgtaaaatttccactcatggacgatgcaaccaacagatgcaatctctgagaagatgaaaattgggacctcttattataaaattgacctagctggactcaggaaaccagggaagaagtcaatgcaggcatttaaaatgtaaagttttttctggttaaatctatttatttttcttgtaggttgagtatttcttcccagtttttctgctctggtgtataacaaacaggtcaaaatttcccatctttcctcctgatagtagttgaatcctaccttgcatacttaatgcatagtgaaatggcatctagcagaaatacacacccccaaaacacaccaccatttcattaggtgcccaaaaaattctgtatttagcttatttatttattgttatttttgcttt

SEQ ID NO: 120040 - DNA, 663 bp, Homo sapiens
  Payload ID: 3545
  Gene Symbol: CLDND1
  Gene Name: claudin domain containing 1
  ENST ID: ENST00000515620
  CDS Start-End: 123-663
ggaggtggctgctgcaggcgtccggcttggacgaaccgccgttcccagtgctgggaccctttaaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcag

SEQ ID NO: 120041 - DNA, 1013 bp, Homo sapiens
  Payload ID: 3545
  Gene Symbol: CLDND1
  Gene Name: claudin domain containing 1
  ENST ID: ENST00000514537
  CDS Start-End: 375-1013
gagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttgga

SEQ ID NO: 120042 - DNA, 2124 bp, Homo sapiens
  Payload ID: 3545
  Gene Symbol: CLDND1
  Gene Name: claudin domain containing 1
  Uniprot ID: Q9NY35
  ENST ID: ENST00000510545
  CDS Start-End: 191-952
agttatggagggggcgggctctgcagggaagtgcgtcagaggaggcgcggggagagtagggtgctgtggtctgagctagagggtgaagctggcggagcaggaggatgggcgtgttgtctgttttagtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaa

SEQ ID NO: 120043 - DNA, 560 bp, Homo sapiens
  Payload ID: 3545
  Gene Symbol: CLDND1
  Gene Name: claudin domain containing 1
  ENST ID: ENST00000502288
  CDS Start-End: 33-296
gagctagagggtgaagctggcggagcaggaggatgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagaaaactaacctaaatacaagccctacatgaatcatggaatgcagatttccagctatgaaggcgcctgtggtcatctgaatgcagagtttcttggacatcatgatgtggtactgcagtgggttgcagatggccacatagcggtcataggccactgctgccagaagaaagcagtctgcagtttccacagtgcaaagaaaataaaactgtactgcacattcatagagggaaatccttttgccctcagaaaagaagttctctaacattttgggggt

SEQ ID NO: 120044 - DNA, 871 bp, Homo sapiens
  Payload ID: 3545
  Gene Symbol: CLDND1
  Gene Name: claudin domain containing 1
  ENST ID: ENST00000511667
  CDS Start-End: 202-871
gcgggagttatggagggggcgggctctgcagggaagtgcgtcagaggaggcgcggggagagtagggtgctgtggtctgagctagagggtgaagctggcggagcaggaggatgggcgtgttgtctgttttagtatgcaggtgatagactagagaacaagacctctgtctccgtagcatcctggcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacacct

SEQ ID NO: 120045 - DNA, 573 bp, Homo sapiens
  Payload ID: 3545
  Gene Symbol: CLDND1
  Gene Name: claudin domain containing 1
  ENST ID: ENST00000510541
  CDS Start-End: 272-573
agggtgctgtggtctgagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtcctt

SEQ ID NO: 120046 - DNA, 569 bp, Homo sapiens
  Payload ID: 3545
  Gene Symbol: CLDND1
  Gene Name: claudin domain containing 1
  ENST ID: ENST00000503799
  CDS Start-End: 97-417
gaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacaggcaattgttcttgttccagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgt

SEQ ID NO: 120047 - DNA, 642 bp, Homo sapiens
  Payload ID: 3545
  Gene Symbol: CLDND1
  Gene Name: claudin domain containing 1
  Uniprot ID: Q9NY35
  ENST ID: ENST00000511081
  CDS Start-End: 51-527
agtagggtgctgtggtctgagctagagggtgaagctggcggagcaggaggatgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatg

SEQ ID NO: 120048 - DNA, 903 bp, Homo sapiens
  Payload ID: 3545
  Gene Symbol: CLDND1
  Gene Name: claudin domain containing 1
  ENST ID: ENST00000507944
  CDS Start-End: 373-903
gcggtgagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccat

SEQ ID NO: 120049 - DNA, 556 bp, Homo sapiens
  Payload ID: 3545
  Gene Symbol: CLDND1
  Gene Name: claudin domain containing 1
  ENST ID: ENST00000508071
  CDS Start-End: 122-556
gagtgagcgggacctgcgtcgccgggcaggggtcgcgtcgcggttccatgttcccggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttacctttt

SEQ ID NO: 120050 - DNA, 862 bp, Homo sapiens
  Payload ID: 3545
  Gene Symbol: CLDND1
  Gene Name: claudin domain containing 1
  ENST ID: ENST00000513452
  CDS Start-End: 129-862
gaggtggctgctgcaggcgtccggcttggacgaaccgccgttcccagtgctgggaccctttaagtatgcaggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacac

SEQ ID NO: 120051 - DNA, 538 bp, Homo sapiens
  Payload ID: 3545
  Gene Symbol: CLDND1
  Gene Name: claudin domain containing 1
  ENST ID: ENST00000513873
  CDS Start-End: 1-219
tttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagag

SEQ ID NO: 120052 - DNA, 999 bp, Homo sapiens
  Payload ID: 3545
  Gene Symbol: CLDND1
  Gene Name: claudin domain containing 1
  Uniprot ID: Q9NY35
  ENST ID: ENST00000513287
  CDS Start-End: 232-993
gggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaaga

SEQ ID NO: 120053 - DNA, 414 bp, Homo sapiens
  Payload ID: 3545
  Gene Symbol: CLDND1
  Gene Name: claudin domain containing 1
  ENST ID: ENST00000506575
  CDS Start-End: 146-414
gtggctgctgcaggcgtccggcttggacgaaccgccgttcccagtgctgggaccctttaagtgttgtctgttttagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattg

SEQ ID NO: 120054 - DNA, 582 bp, Homo sapiens
  Payload ID: 3545
  Gene Symbol: CLDND1
  Gene Name: claudin domain containing 1
  ENST ID: ENST00000512147
  CDS Start-End: 218-582
gtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgc

SEQ ID NO: 120055 - DNA, 539 bp, Homo sapiens
  Payload ID: 3545
  Gene Symbol: CLDND1
  Gene Name: claudin domain containing 1
  ENST ID: ENST00000503621
  CDS Start-End: 125-539
agggtgctgtggtctgagctagagggtgaagctggcggagcaggaggatgggcgtatgcaggtgatagactagagaacaagacctctgtctccgtagcatcctggcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtg

SEQ ID NO: 120056 - DNA, 681 bp, Homo sapiens
  Payload ID: 3545
  Gene Symbol: CLDND1
  Gene Name: claudin domain containing 1
  ENST ID: ENST00000508659
  CDS Start-End: 165-681
atggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgcca

SEQ ID NO: 120057 - DNA, 974 bp, Homo sapiens
  Payload ID: 3546
  Gene Symbol: CLDND2
  Gene Name: claudin domain containing 2
  Uniprot ID: Q8NHS1
  ENST ID: ENST00000291715
  CDS Start-End: 427-930
gtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggactgctgctgctgaccgccttgataggctacaccgtgaagaatgcgtggaagaacaacgtcttcttctcttggtcctatttttctgggtggctggccttacccttctcaattctcgcgggcttctgctttctgctggcagacatgatcatgcagagcaccgacgccatcagtggattccccgtgtgtctgtgactgcagcctgcctggggcagaataaaggaacggctttttttagc

SEQ ID NO: 120058 - DNA, 417 bp, Homo sapiens
  Payload ID: 3546
  Gene Symbol: CLDND2
  Gene Name: claudin domain containing 2
  ENST ID: ENST00000593841
  CDS Start-End: 1-328
cgtggtgggcatggtgatgggactgcggattcggtgcgacgagggcgagtcgctgcggggccagaccacgagcgccttcctcttcctcggcggactgctgctgctgaccgccttgataggctccccagctgccctcccaggaaaccccggggacctctcggggactccccaacacactaacgactcccgcagacccggcagagacccccttggagccccaaaccccagtccccggggccctcccggccatccgccccagggcccaccttcctctccctgctccgcacccccgtccccccaggcttctgctttctgctggcagacatgatcatgcagagcaccgacgccatcagtggattccccgtgtgtctgtgactgcagcctgcctggggcagaataaaggaacggcttttttta

SEQ ID NO: 120059 - DNA, 575 bp, Homo sapiens
  Payload ID: 3546
  Gene Symbol: CLDND2
  Gene Name: claudin domain containing 2
  Uniprot ID: Q8NHS1
  ENST ID: ENST00000601435
  CDS Start-End: 30-533
gagccctagggcactgggtcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggactgctgctgctgaccgccttgataggctacaccgtgaagaatgcgtggaagaacaacgtcttcttctcttggtcctatttttctgggtggctggccttacccttctcaattctcgcgggcttctgctttctgctggcagacatgatcatgcagagcaccgacgccatcagtggattccccgtgtgtctgtgactgcagcctgcctggggcagaataaaggaacggcttttttta

SEQ ID NO: 120060 - DNA, 3486 bp, Homo sapiens
  Payload ID: 3547
  Gene Symbol: CLVS1
  Gene Name: clavesin 1
  Uniprot ID: Q8IUQ0
  ENST ID: ENST00000325897
  CDS Start-End: 319-1383
ctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaacacctttttacttttcaa

SEQ ID NO: 120061 - DNA, 709 bp, Homo sapiens
  Payload ID: 3547
  Gene Symbol: CLVS1
  Gene Name: clavesin 1
  ENST ID: ENST00000524095
  CDS Start-End: 704-709
attcccctcctatccttccccccaagtctccaaagtccactgtatcattcttttttttttttgagacagactctcattctgtcacccaggctggagtgcagtggcacgatctcggctcactgcaagctccgcctcctgggttcatgccattctgctgccttagcctcctgagtagctggcattacaggtgcccgacgccacgtcaggctaattttttgtatttttagtagagatggggtttcaccgtgttagccaagatggtcttgatctcctgacctcgtgatccgcccgcctaggcctcccaaagtgctgggattccaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatggga

SEQ ID NO: 120062 - DNA, 3622 bp, Homo sapiens
  Payload ID: 3547
  Gene Symbol: CLVS1
  Gene Name: clavesin 1
  Uniprot ID: Q8IUQ0
  ENST ID: ENST00000519846
  CDS Start-End: 473-1537
gaatcgggcgcacacgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggcagttttcttagctgtgattcccactgctgccattgtctgtgcaatcacatccagaagaagggtcacggttacatggatctgctgggaaaacaattagtggaaaagggggcaaatagagttaatggccgtttttggtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaa

SEQ ID NO: 120063 - DNA, 552 bp, Homo sapiens
  Payload ID: 3547
  Gene Symbol: CLVS1
  Gene Name: clavesin 1
  ENST ID: ENST00000522621
  CDS Start-End: 316-552
gctagttctgctccaagaacccaagaggtaaggccttcagtcaagaggacagcccacgtctcattgttccagtggcctaatcaagggaatggaagatgaggagaatgaaggctctgggaatttattttcatcgtggaccggactttttatcagccaggaaaaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagattt

SEQ ID NO: 120064 - DNA, 582 bp, Homo sapiens
  Payload ID: 3547
  Gene Symbol: CLVS1
  Gene Name: clavesin 1
  ENST ID: ENST00000523868
  CDS Start-End: 552-582
ctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggtatttgttaccttttttctcccctctgtatttgccgagcctccccgcctttcccccgctctttcgatgccatggctgcggcgtttcagcacttcggcagttttcttagctgtgattcccactgctgccattgtctgtgcaatcacatccagaagaagggtcacggttacatggatctgctgggaaaacaattagtggaaaagggggcaaatagagttaatggccgtttttggtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatc

SEQ ID NO: 120065 - DNA, 661 bp, Homo sapiens
  Payload ID: 3547
  Gene Symbol: CLVS1
  Gene Name: clavesin 1
  ENST ID: ENST00000520712
  CDS Start-End: 484-661
aactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcagaagatggataaaatcaatgctgaggacctattcagaaggacagtgatgccagagctagttattcattgaactcattctgtgagaaatgtcagccaatctttggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatg

SEQ ID NO: 120066 - DNA, 2880 bp, Homo sapiens
  Payload ID: 3547
  Gene Symbol: CLVS1
  Gene Name: clavesin 1
  ENST ID: ENST00000518592
  CDS Start-End: 550-777
ctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaacagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctctttctcaatggatctaatgttttaattttttcccctattggtagagaacaataacagaagtaatttttatattatacacttggagaaataaagttgaaacagaattaaaaatatttctcaaacaactgtatcacaatataaattaaactaattcatttttgtgtagacatacgaaatcacaaaaataataacactgaaataattctaccaatgcagtgatggaaacacttttcttatgtaccaagacatagataggtaagagaaataaagaattgaagtgaattagaaaatccattttattgcttgggtttaaaatagttgtgggatacaagtatttacaatgctattggagtcaattattgacaacactttgcaacagtaataccatttctagcttttcaattggcaatacttagaaccttactgtagtgacctgattttaaataccatattatatttactaagttaagagctagtttttactctcttccataatttcattacatgaatgtaagatgatggctcaaaaatgacgacttatagtttgaatttatgtgtatgcaatatacatatgagaaccaaattcaacaagtgacatgaatgttactacatgaacattgaattgtattgcccttgtcagttatttcctctgttcaataaatactgaaggtcacaaacacctttttacttttcaa

SEQ ID NO: 120067 - DNA, 11485 bp, Homo sapiens
  Payload ID: 3548
  Gene Symbol: CLVS2
  Gene Name: clavesin 2
  Uniprot ID: Q5SYC1
  ENST ID: ENST00000275162
  CDS Start-End: 1336-2319
acaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctgatgatctctctccgccctggagctcagcgctgaagagctaccttattattaatcagaatttccatcgccacccctggcaggcgtatccttcagcagggaccgcaggaacattcacagtgcaggggctgagatgtgcgtgggggttgtttttgttacatcttggaagagaagagaagaggacagtaccaagatcagaaacacccgtgctaggtggaattaggggtgatttgttaggaaagagaaaggacaagaagaggagtgcggagcccttcaggggttcacatctctttaaaggaaaggaaagagggagccaaagtagggtgttgtattttagggggcagaggaagaagtttacaccccccggcccccccagctttgctgggggaaagcaggagcaacagggcacttgattggacaccaagattattaatttcctgtaggggagaggaagcaggcagcaggaggtctgggggctggagtctggtggtggcaaggaccaggtttgctttgggacagtcaacaaggtcttctgagggaaagctcagagataggcagaacaatgactcatttgcaagccggtctctcccctgagaccctggagaaagctcgcctggagctcaatgaaaacccagacacgctgcaccaggacatccaggaggtgagggatatggtcatcaccaggccggacattggctttctgcgcacggatgatgccttcatcttacgcttcttgcgggctaggaagtttcatcactttgaggccttccgcctcctggcgcagtactttgagtaccggcagcagaacctggacatgttcaaaagctttaaggccaccgaccctggcatcaagcaggcactgaaggatggcttccctgggggcctggccaatctggaccactatggcaggaagattctagtcctttttgctgccaattgggatcagagcaggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaattgctgtcttcacaatgtgccctttattcaagaccctattatatttcttcctaatgtactctaagtacatttcccctccaaaactctttgactaagagaatgagaactcatgtgaacagtgttctgacagctaattttgaacataaaattttccacttacagatgaggggctaatttctaattgttgtgcactggttaaaaagtatatatatatatatattcacacatatatatttttactgagctctaataaatccttaatgtgacaggcttataaaataaatcatagatattcaatgatcttatggataattacatgagataactctggaaaactacttccactgaagttaatgaaaaggagaaatagtgaaactgactttcagtgtacctatttaaaggaattccaagttaatttataatgcaatcttacatatgtgccatcttatttgaactatatttttccttcaaagaagcaataggtctcaacatagtgtaggtagcatcaggtgacagaaagccaattttattttcaaatttaagttaattatcttcgtgatcctatttatccacaatttctttcagaaaagactgaaaaaacacattatattcaggagatataatgaaattattggaaggcatctatgacaacatgtaatcatttatacgtggatttagaaatttgcatatttaacattttatttcataaaatttatacaattacagcaaatcttaattttttaattttaaatttcaatgtgaaaaaatgatttttatcacccataataaattttgagattgagagtttaccattaaagtattcttttggaagaaaaatatctcagaaactcttggaaaccaacaaaaataaaggcatgtgtcagccttcatattttttggccaaaagctcccaaaatttgttataattctgcagccaaaaattgtaaaagcaagctgaatacaccaatgtacagtgtatcaatggactgcctcatgtgtgtaaaaatacattaattaacacaaatgaaagataccttaataatgccaacctccagtcaagtgcagaagaataatgactgtcaggcactctgctctccttgtgacttttacagagattggaatgcactggggacaacatgtctcagcagttcttacctttataagaattctaaccattgatattcttacattcttgcctacctgacatacattttgtagccatgggctttttagactatataaatcttaggcagtataatccattggaataaaatagaaacattgtaagtgcagagggcagtcaacttttcattctcatgagtttctcttgatgtgtaccatttattgccagttttcagaattctgccagtttcagatgtcaaccagcattggcagcttctttcccctatcgtaaagttagtgtcatatataaaaataactagaaaggcatattttatatgtatgcctatctaattataagtatcattcacactgtctcccagacccacatttggaaagtttgcattgcattactgctcatctttagatgagcaattgagagttggctagattgtgtaaaatattttaaaatgaatgaacaaattacaatgatgatgccttttgaaattaccatatctagttcattctgtgaataaactcattttctagtaatgtttgtgaaccttagtcaagggatattcattcaactttataaatttacccctcagcaccagctatctagcactgtttaggaatttttcccttcatgatattctgtgtcacatcctatgtctatgaataacctatacactatagttgtatgcctataagcactcctatactcttgtattttaattgcaatagtatacctccactctctctctctctctcatacacacacacacacacactcttacacacacactaacacactagactgtttgccctaatgaattttcctctgtacttcgagagctattttagttgtcttgtcacttgaaatttgcgggcttcaaagaattatcgcatttgacttggaatggtccagtagtccatttacttctttcaccctgcctgttccatcttctatttctgatattttttctttcttccagttatttcaggggcaggtgattccaaagctggtttaaaaataaataacttctcttatgttgtcagtgatgtttgcctgcatttttgactactatttaagagggaagagattatcatgaaaatatactctaagaaatatgaagaagtgcctctttgaaaatggaataaagcaacgttactggcatatggattttatttgtactctcttccaaaaagtaaatacgtaaatctatattatataggtgaaatatagatatcatttgaagaaggatatttaaggcctttatttgaacatactcatacagtattaagtctctgttgtgtaagttaaatacagtaactttagtacatgttaatgataaacgtggcactaggctaaaacgatatacgagtattaaacagagttttgcaagcaagtttttgaagtgggcatgcatgaattctttcatttcagtaatggtttgcataagtgtagacagagatatttcctaagttttttcatatagaatacttatttactttatagtaccaaaaattcatacattcataagcaggaaagccaaaaattcatacattaatacttagcttttttaatactgttaactaggtcatattgttaaacatgtgaagcgtctgtaatattcctgagggaaaagaggtccctctattgcatcaagaaattggagagttgttttagacattggggaatatgtttatgactcttcacataaagaaaccttcagagccatggagtatgtcttcagggacagggatcatttgcttctacaatgtaaaggtttatggacatatctctggtcctttaaagaagttacattaagaaagcttgctgagaggctgtacactcttctgttgttttatttaaaggtctgccttgtgtggttggtgaataatatctcagcttctttttttgtgtatatttattaatgattacatgaaaagttgccatcagccatgaggacacttcaaaaattttcaacacactaaataaaatgagcagagctctagcatgatatttgaactttcagatatggtatatgtacattttttacaacaataagctcataggcatatattccattgtagatctgctatataaatacatagcctgaaacatagtaatgcatttgaaatttgtgaggtcactgatcatacaagaagaggcagattataaaccaacatattggaacaaaagaagattggttaaatatgcaaggtgtgtaattatcttcagtaatgaaaaggatttgttttcttgtttttgtctttggttttagttgaaaaaatagcttcccatatgctactggaactatttgacattatttgctacatgaaaaaaggcaaataagtaaacatacaaaagaagcttggctttgtaacattattatattatgatctcaatggcttagagaatataatcttttttaagaattaaagattttattttataaatatttggaggttaacataggacatgaaaatagtgctgtggattctgttatgtactaactatgggaatgaattctccagtaccataggaaaatatataagataacaactttgtggattgaaacactcaaattagcctttttttcaaggaagcaggtgtacaaatgatgctattgaaataaaaaaatgtagaaatcacttaattataggagttaaatataatcaatgcactcatggtaaataatggaaattgttaaaatttagaagagttttgtcattatttgacttagatttaagtctcagtgcaaatatgtctgtccttgatatagtgcatttattctgtaagacttattttacctggtgaacgagatggacttaggtgaaaataaattttaaccacagttttaagggtcacccaatcctcaactactttaaaaaattgcaatgaattttaattcatttacttttaacagagatacaaagcactgtcttgtttctaatccaatttttcaatttttcagattttatatttgcttaaacaataaataaaactcagaaaaccaaatagtttttgttttcaaagctatccaggaaaaataaaagatgtctaacaggaaatcatacaagtccttgaagaatactgagtatattatttgctattttactcaaatgttattaatttttactactacaaactacttatttagtactacacggcatttactatttggccttttgaaggagttataaattccaaaacactataatataatttttggacaagtatacatttctgtttaaaagaaatgtatgcttttattttgtatattttatattttaaatgtatacatttattttgcacattgttaatgttaaatttggtagtcctggatctgctgcatctataaaatggagatttctttaaaaaatcgtctaaaaattagcaatatttttattttgagagaaattgtgcttagctatttaagttaagattcctcaagtttgtgatatttgtatgtgtggggatcaaagaggaaaatatatagtaatttgtttcatcaaaatgacgtattcaatattctataacttctagtcaaactttcaaatgaaagtttgaaagaagtaaactaatgttttaattacatatagcaaaggaatgatcagtaaataaaataactagggttttcacatttgcaatagaatgactggattaggcaagagattaaatttagaaatttgaattacagaaaagcattggtttaaataaatcctcaaaaaagtaatcccaggtcaaaatatgatgtgaaattaaaaaaaaaattcagcctgatttgagaaagaatgcttactcaataaatatgtatttgtgtcttctgtgagtttccctcatttatcctatctgtggatgaaaagtcatctaataaggtataagagactcaattacatttacctagaaccatctacaagtagacttcatgaatttctttggctcaaactcagaggattttctttacacaggattcttgaggttatcaagaatcgttattgctgctccctcctaaaggcaggccaggagaagccacatttccagcagtagtatcctcagtgggaatgaaccagaaaacaaagaaaaagccagagatattgtctccactctcgttacaaaaaagtgcgttccttcttcaggaggatcgagtagaaaatattttctactcgaagaggccatggggaagtgatggtcaaatctctgttgtgaagcaagtttccacacagaaacatcatcaaaaacacgtacctctgagcatcacttctttctctaaaaataaaaataaatatgctgttttcctcccttttttctaattggcatcataaaagtataagaagccacaaatgcattgttgccacttaagaaaaaaatcctatgttatacatatatgaacataattcacttagttgcatatgattgaaatatttgcatgctggtttataaattattacctaaaagttttatgaaatataattattaagttttagtgctagaaaaattgttgttttttgtgttttgtattcatagggaagactagtaatatcccttactcctcattcatatagctaacaattttaattggatggctaatggatatggcggatttaacatttacaaaaccaaactactttcactctgaccctgcttcccctttagccttctcatctcactatgtgtcgaccccaatcttccagtttctaggaataaaaattttggagtcatcctctctttccttcctctttttctttcaaaactacatcacatcagctagctcatgctgttgggtcttcaaaatatatccacactctaaccacttctccaatcttcttcactgtattggaccaagtcttcaacattttccatctggaatattttaataatctaaaaactagtcttcttgcttccagagtcaattttcaacacattagcaagagtgagtctcttaaaatgtaactcagaccattttgttctccaaaccctctgaaagagtaaaagccgatgtctttatatcagtgtatgagaagtcttgatatgaaggcagtaagcaccagtacagcaacatagcatggtttctgattgggctggcatttttgctggtactatgaaaaaatagttgttaaatactttaatttcttgcttctgaagttctctaccccgttcttgccttttcttagataatctcttaagaatctctcctttatttactgctgccaaactgtcatctttgctgttccaggaacttgctaagcatgcctctacctcaggactttcgcatttctgttccctttgcctctaatttcagatatccacgtggtttattccctcatcttcttcaggtatttgcttaaatgtcatcttctttgtgaggactctctttcctaattttagatgaaacagccctgtggttcttcatattctcctttcctgctgtatttcctctccatagcatttatcacctgatacaccatacagattatttatttactttgcatttccccccaatagcaatgtgaactccacaagggcaggaatttttgtctgtttactactgcattactggtgccttgtacagtccctggaacttaacaaatccaaaatgatttcatgaggatcctaatttgtttcagcaagttatgtaacggccaatagtatgaattgaaagagtttcttgttgtcttaatttaaaaaattttgttatttatcttcaaaggggaaattttaccctctcatgataatagaatcatgaatcaaaaatgatatcctcttctccccaattgtgatctctatccctgagcctaagttttacatcagtatttcagttttgtctttagaagttactcaacgatcactggaccctatatctatccacatggcttactcttggagagactacaagatagctcaggggaaaagtcattttgagattaaaactacatggaattgttctttatggattatcatggttaatttcaatttttaaaaatatgcaggaagttaaaagactataattccagtattggaagccagtttaagagaatatgactatgtagttacttttaatggaaaggggaagaagaggaagaaaaaggaaagacattgtgttcgtatcttctctgcaacaattataaaatgaatgaggaagtattttggtgtttctaaggtctttccatgatcttgaaatctatatattatagtcatttagtctgtgaaccattttaacaattgggtttcatgttacatatctttaaatttttatgttgaaaatttatagctgtgacacaagatgatagaaattgctcatgctcacatatattccaactggcttttcagcttgctcccttctcttttaatttcagctatcatttttagagccttacagtcacaattgttcttaactatcccaaatttttatttcctatttggactgacttctccataattttagtaactaaatgacctagatattggttcttgttgtgataggtttctgatttgtatcctttgcagtttaacttttaatccttaccaaacatatgttattccttttcttcagctacattgttgtgcctttcccaacactgtaataatttaagcctcctgttttataatcttctatcagaacatatattaagaagacactgaatttaaagaatcagcaggtgatgttgaagaagaaatataacctgaaatataagaatagatgtttgaaactgtttcagaagttaaccagtcttttagtggctttgtaatgggtaggggttttattcctctttgtgtgctatgtaggacattgttaaccaatatagattatgtttcttgtcagttacacaaggataggtaatcagggttaacagttcggaaaacattctctagagaagagactaatgattcttgctcacaaacaaggcagaatttccttatgtttcttaatatttgatccttgatagtctgtacagtggaaaccatttccctctgtgatatccttttttgccaacctatatgaatgtgtttagcgtcacttcagatatagagttcaagctcaagtatacacagcacatgaaagatcctatagttcatgttctcttaggttgaattttcttttcataattttttatgattgaattctaagggtatgttccttggtaaattgtgttaattatgtccactttataatggatttaacaattttacaaagcagatcattgtttattatattctgaaaaccattatattaatattttatttctttttttgcagagaaactattgtcttttttgatttctgaggatgaatgaagtactgttaaataaaatgtcactaaatgaaacttcaga

SEQ ID NO: 120068 - DNA, 1359 bp, Homo sapiens
  Payload ID: 3548
  Gene Symbol: CLVS2
  Gene Name: clavesin 2
  Uniprot ID: Q5SYC1
  ENST ID: ENST00000368438
  CDS Start-End: 108-653
ggctgatggatgccagggagtgccgcattgcttagcgaccccgcctctgggtttgctggtacacactggtggatattttgcgtgccatcttactttctttagaagccatgattgaagatcctgagcttcaagtgaatgggtttgttttgatcatagactggagtaacttcactttcaagcaagcctctaaactcacaccaagtatgctgcgattagctattgaaggcctgcaggatagtttcccagcgcgatttggaggaattcattttgtcaatcaaccatggtatatccatgccctgtacaccgtgatccggcctttcctgaaggagaaaactcggaaaaggatatttttgcatggtaacaacctgaacagtctacaccaactaattcatcctgagatcctgccctctgagtttggaggaatgctgcctccttatgacatggggacatgggcaagaacactgctagaccatgaatatgacgatgacagcgagtacaatgtagactcctacagcatgcctgtgaaggaagtagagaaggaactctccccaaagtccatgaagagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaa

SEQ ID NO: 120069 - DNA, 1634 bp, Homo sapiens
  Payload ID: 3549
  Gene Symbol: CLP1
  Gene Name: cleavage and polyadenylation factor I subunit 1
  Uniprot ID: Q92989
  ENST ID: ENST00000302731
  CDS Start-End: 121-1206
tttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcaattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcat

SEQ ID NO: 120070 - DNA, 553 bp, Homo sapiens
  Payload ID: 3549
  Gene Symbol: CLP1
  Gene Name: cleavage and polyadenylation factor I subunit 1
  ENST ID: ENST00000533905
  CDS Start-End: 157-553
aactgcgtttgtttccggcgtgggtccgggcaagaaccgcttgtagtttggtttaaattctgcacgggaggaccttctgagtttacctgttgggctcctggctgcgcagatctgatatttaatttgtgttctaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgcc

SEQ ID NO: 120071 - DNA, 1778 bp, Homo sapiens
  Payload ID: 3549
  Gene Symbol: CLP1
  Gene Name: cleavage and polyadenylation factor I subunit 1
  ENST ID: ENST00000529430
  CDS Start-End: 55-1365
aaggtagtaaaaagaggattatagacgtggtggaacctgttggctgcggggcaaatgactgacctgcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaata

SEQ ID NO: 120072 - DNA, 2435 bp, Homo sapiens
  Payload ID: 3549
  Gene Symbol: CLP1
  Gene Name: cleavage and polyadenylation factor I subunit 1
  Uniprot ID: Q92989
  ENST ID: ENST00000533682
  CDS Start-End: 726-2003
atgactgacttgtagctggaagaaatcatcggatttttattcttttattaaagaaaaaaaatttgaaatgccttccatgtgccaagcactgtgtcaggtgggagatgacagcttggtgaaacctctgtcaggctgtcttcctccgctttctctatccctgggtttccccctgcctaaaaaggattttgtgcttcgtggcttgtccaggcaagcaggccgtcgcgggacctagaccgagacagtgagtctctctttctcccgggcctcccttctgtttcctgggctgcaggggagcaggaaatctggggcgagattcccgccgcggacgcgcactgccgaagcctggtccctcgacctgtccctgcccagcgcgggggcgcaaccgccacgcctcctcacccctccctccggctgcacgaataatgacaacagccgcccctcccacctttggcgtcacgttcaaaacaatcctttgactacaactcccagaaggccgagcggcttagcgagtgcacccgctctcggctgctccggcaaactacacatcccaaagggcagcgcgcgaccgcgtgtcctttcacagcgcaagtgcggaactgcgtttgtttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcatagaa

SEQ ID NO: 120073 - DNA, 566 bp, Homo sapiens
  Payload ID: 3549
  Gene Symbol: CLP1
  Gene Name: cleavage and polyadenylation factor I subunit 1
  ENST ID: ENST00000529773
  CDS Start-End: 291-566
attcccagtcaagccaaggaaaggctgcacagaaggccagagaatcacaaaggggagtaggggtcattttttcacccatctcggatcacagggagaagcaagttgggcaaatgactggagaaaaaacaaaggcaagccgagtgctggggagagatgttcccctgaagtgagacggggctggaccgtaggagaaaggggagagggagggctggcgggggcaactgacagctgacagcagaggcgccgaggcggaggctggaggaaccaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctt

SEQ ID NO: 120074 - DNA, 1392 bp, Homo sapiens
  Payload ID: 3549
  Gene Symbol: CLP1
  Gene Name: cleavage and polyadenylation factor I subunit 1
  Uniprot ID: Q92989
  ENST ID: ENST00000525602
  CDS Start-End: 115-1392
ttgtttccggcgtgggtccgggcaagaaccgcttgtagtttggtttaaattctgcacgggaggaccttctgagtttacctgttgggctcctggctgcgcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtag

SEQ ID NO: 120075 - DNA, 580 bp, Homo sapiens
  Payload ID: 3550
  Gene Symbol: CPSF1
  Gene Name: cleavage and polyadenylation specific factor 1, 160kDa
  ENST ID: ENST00000531042
  CDS Start-End: 24-470
cttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtgg

SEQ ID NO: 120076 - DNA, 4462 bp, Homo sapiens
  Payload ID: 3550
  Gene Symbol: CPSF1
  Gene Name: cleavage and polyadenylation specific factor 1, 160kDa
  Uniprot ID: Q10570
  ENST ID: ENST00000620219
  CDS Start-End: 131-4462
gtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctag

SEQ ID NO: 120077 - DNA, 506 bp, Homo sapiens
  Payload ID: 3550
  Gene Symbol: CPSF1
  Gene Name: cleavage and polyadenylation specific factor 1, 160kDa
  ENST ID: ENST00000532935
  CDS Start-End: 1-506
gcctggccagcccttgaccaagaacaagttcaaagtcctttacgagaaggagcagaaggggcccgtgaccgccctgtgccactgcaatggccacctggtgtcggccatcggccagaagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttg

SEQ ID NO: 120078 - DNA, 704 bp, Homo sapiens
  Payload ID: 3550
  Gene Symbol: CPSF1
  Gene Name: cleavage and polyadenylation specific factor 1, 160kDa
  ENST ID: ENST00000531727
  CDS Start-End: 1-615
atgaagagcatttcgctgctgcgctaccaggaggaaagcaagacgctgagcctggtgtcgcgggtacacctgtggcggcggtgctcgtgtctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaga

SEQ ID NO: 120079 - DNA, 4494 bp, Homo sapiens
  Payload ID: 3550
  Gene Symbol: CPSF1
  Gene Name: cleavage and polyadenylation specific factor 1, 160kDa
  Uniprot ID: Q10570
  ENST ID: ENST00000616140
  CDS Start-End: 76-4407
ggcccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttga

SEQ ID NO: 120080 - DNA, 13035 bp, Homo sapiens
  Payload ID: 3551
  Gene Symbol: CPSF2
  Gene Name: cleavage and polyadenylation specific factor 2, 100kDa
  Uniprot ID: Q9P2I0
  ENST ID: ENST00000298875
  CDS Start-End: 286-2634
tggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatggaaaatagtcaaagatggagaagaagaaattgtttatgcagttgacttcaaccacaagagggagatccatttaaatggatgttccctggaaatgctaagcaggccttccctacttatcacagattcattcaatgctacatatgtacagcctagaagaaaacagagagatgagcagcttctgacaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgagattcaacttacataccataaagttcactcttctaaagtgtacaattcattggtgttagtatatttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaacttttatgtttgacttctttcacttagcataatgttttcagagtgcatcactgttgtaacatgtatcagtaccctttttgtgactgaatattattccaccgaatggatataccacattttacttatccattcaaccgttgatgtacatttgagttgattccaaattttggctattaagaatgctgctctgaacattcatgtgcaagtttttttttttttgtatgtacatatgttttcaattttcttggatatatatctaagaattagaattgctggatcatacagtaattctgcttaaccttttgaggagctgccaggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgactgatgatgtggagcctctttccatgtgtttattgactttttatatattttggagtaatatctgttcatatcctttgtccattttcaatttgtttatgttcatatcctttgtccattttcaatttgtttatctttactgttgagatgtaagagtttttttatatattttctggatactaaaccattatatattgatttgcaagtattttattccattctgtggcttgtcttttcactttcttcgtagtgtagtttgaagcacaaaagtttttaattttgataaagtccagtttgtttttttcccttcagttctttgtgcttggttttatatctttttttttttttttttttttttttgagatggagtcttgctttgtcacccaggctggagtgcagtggcgcggtctcagctcactgcaacctctgcctcccagattaaagggattctcctgcctcagcctcctgagtactgggattacaggcacccaccaccatgcctggctaaatttttgtatttttagtaaagacatggttttgccatgttggccaggctggtcctgaactcctaacctcaagtgatccaccaaccttggcccccaaaagtgctgagattacaggtgtgagccaccttgcctggccttggttttatatcttaaaagctattccttcattcaaagtcacgaaggtttacacttaatttttttctatctaaaaaaccattgcttcatctaaagtcatgaagatttacactctttttttttctaacagttttacagtttaggctcttatcattaggtctttcatttattttgaattattatcattattattattttctttttgaggcagggtctcactctgtcacgcaggcttgtgtgcattggtgcaatcacagctcactgcagcttcagccttctggcctcaagcagtcctcccacctcagcctcccaagtagctgagattacaagtgtgtgccaccatgcctgactaatttttaaaatttttttgtgaagacagtttctcactctgttgcccaagctggtcatctcaaacttccagactcaaacaatactcccactttggctgcccaaagtgctgggattacaggcatgagtcaccattcctggcattaatttttgtatatggtgtgaggtaggggtccagtttcatttttttgcatgtggatatccagttgtcccagcatcatttgttgaaaagactatttcttcattgatttttttctgccacccctgtttaaaatcagttgcccatgagtgtatgggtttgttcctggacttgaaattatgtttcattgatctatatatctatgctagtaccacatgtcttcattactgtagctttgtagtaacttttgaaattggggaagtgtgagttccccaactttagttctccttcaggattgttttggctattctgggtctcttgcattttcatgtgagtttagattctgcttatcgatttcttttttttctttttttttttttttgagatagcatcttgctttgtcacccaggctggagtgctatggctcaatctcagctcactgcaacctccgcctcctgggttcgagagattctcctgcctcagcctccagagtagttaggactacaggcgcgtgccaccatgccaggctaatttttgtatttttaatagagatgaggtttcatcatgctgaccaggctggtctcgaactcctgacatcaagtaacccggctgcctcagcctcccaaagtgctgggattacagtcgtgagccaccatactcagcctaagattcagcttaccaatttctgcaaaaaagcccactcatttttaataggaggtaaaaagcagttgacatttataacttagagtcttttaatgttagtgctgaaagggactagagagctcatctaattcaacccacttattttagtattgaatgaatgaccctgtacaaggaaagggatttgcttgagatccacacagctgtttaaaggcagagttgggattggaaccaagtcttagagaatccattgttgcttctacactgcattattgctttggttccctagtgtacattcactttgcttaggagtgatatgttcagtttatcttctctaagaatggcagctgttatttaggacagtggcatgctgagaaatagattgatttctattctatactgtgtccagtaaaggtcgggggagaaagagtaaatcttatcttcttctgtacttttctttgattaatgtaagagtctagagttttatcagaagattattgtcctttaaaatattgatggactgattatcacttaaagggtataaacagtgggtagtaattcagtgattgagaggttaattgcaggttttttttttttttttttctggtaaccatagaatgaatgtagaatgaatttggattcaataatgggaactaaggtcaggcgtggtggctcacacctgtaatcccagcactttgggaggccgaggcgggtggatcatctgaggtcaggagttccagaccagcctggccaacatggtgaaacctcatctctactaaaattacgaaaaattagtcaggtgtggtgacgggtgcctataatcccagctacttgggaggctgaggcagtagaatcgcttgaacccgggatgcggaagttgcagtgagccaagatcacgccactgtactccatcttgggcgacagagcgcaactctgtctccaaaaaaaaaaaaaaaaaagggcagggggagcggctagagaaggaacattcaaatcttcccacgtgggcaagttccaagcaaatgtttatttttttacctcctctttggtttttgtctcacttgaagcactttgtgtttatgggaaaataccaaaaattaccaaaatttaaaaacccagggctttgctggaagtgagggtatcttcttggcttttcccttttcctccccaccactatacgcacatgcacacacagctctattttttggtgcttttcgttcattattcactccatttcattttagctcttgaagtcaaaatgggattccaaagagcaaaatagaagtttggagagtttgaaatctctcctcgtggctggacgccgtggctcacacctgtgatcccagcactttgggaggccaaggcaggcatactgcttgaactcaggagttcaagaccagcctggggaacatggtaaaaccctgtctctacaaaaaatagaaaaattagctgggcatggtggctgtagtcccagctatttgggaggctgaggtgggaggatcacttgagcctggggaggttgagactgcactgagtcttgaatgaatgaatccatctctctttctctctccatatagtcaaagagaaccaaaaatgtatgtgctttttttgtgaaattgttaaggattccatgatcctactaaaatttttgataatgataatttcaagtggagaatatataaaggactcgtgaggccttcctacctcattttctgaggttatgttgactttaatatccaatgtatcataggtgttttcttttttctctgacaattgttatgttaaaaacaaaaagaagcacatactgtacagtcaaaactatcagacgtaactctgtgggaaactttattccaagggtgctgccactgcccttgttttaaatatttttggaacttcatttctcttcaggtctatttaataagcttgttaggaatattgtaaattattttagaaacacattgtggtctcagcctcatgtggcattgccacttgttactacatgacccccccacaccccctaaaaaagaaaaaggactttaaaaaccctctcaggacaaacatttgctaccgtggttgattttttaattttacattaactatttaatatcagactataactaaaatacaagtagtggaattatacttttataaagtatcaaattatgtagatgatgacgaagttataaggttactataatttccaacttcacccataggtcatggtatagttgaaatttcatatttaaatatcaaaacataaatgtctaaagagattgtgtaaattctttatcagttataaggaaaaaccaaattcaaattcttaaggtttttcttatatgtgattttttttttttttttttttttgagacaaacttgcagggagagaattatgtggcatgaggaggattgagaatgttgttcattttatctaattactgcctattaagaaaagcttcacatttatttcagctattctattgaatacttttacctaagataatgaaaccgttaagtagagatttttctaatagtataaaaatcagtgtaggcccagcacagtggttcacacctgtaatcccagcaccttgggaggctaaaggcaggaggattgcttgagctcaggagtttgagaccaacctgggcaacatagtgagaactcatctctattaaaaatcagaaaaattggccaggtgtggtggctcatgcctgtagtcccagttactcaggaggctgaggcaggaggatcccttgagattgaggcttcagtgagctaatgatcgcgccactgcactccagcctgggtgacagagtgagaccctgtctcaaaaacaacaaaaatctcagtgtgacaaattcctaacagctcaaatactacttgtcttatttgttaactattttgaaataattttaaacttacagaaaagtagaatagttcaaaagatcctgtatatccttcccctagattcttctattgttaacatcttgccatattttccataccactctctagctatgtattcacattattttttgaactgtttgttactaagttgcaattgtgatgtcccattagtactaaatacttaagtgtatactttttaaaaacaaggacactcctacataaccacagtacttaaaatcaggaaaccagcattgataaaattctaccatttgatccacgaaccccattcaaatgttgccatttactccaaaaatatccttacaataaccctttccttttttggtccacagtccaatcaggatgaagcacgcatttagttacattttccctttagtcttcctcaatctggagcggttccttggtttttccttttttgtgaccttgacatttttgaagaatgcaggccaggtactttgtagaatgatgtgcactttgggtttgtctgatatttcctcaagattagattcaggttgtgaatttttggcaggaataccagagaggtgatgctgtcttcttctctgcattgtatcaggaggcacatcatgtcaattttttccattactggtgatgttaatttttaacagttggttacgatgttttcaagatttctccactgttagtattttctccacttgtatttgttttttggtataaacttaaaaagtacagcatgatgttttggtatatgtatccatagtgaaatgattattacaggtattaattaatgaggaattacgtattttgtgggtagctattttgagactctcaatatcctatttctcaaaattttaccctttacttttagcatccattgatgatccttgtctggatcagttattgccaaatggtagttttcttttcttttcttttcttttgagacagtgtcttgctctgttgcccaggctacagtgcagtgatgagatcatagcccactgcagcctcaaactcctgggctcatgccattttcccctcagcttttggagttagctgggactacaggcatgcatcaccacacccagattatttttaaagtttttgtagaaacggggtctcttcttccccatttattcaatatttatatcagtatagaacatgggtccctgttttatcatctgtaagttatgatttattttgatgcccccattgtccaagatttgactagcgagagcactttccagctagctcctgtgtcctttggacataccccatggttcattgagcacttccttgctttctggcaccacaagatgttccaggctcgtcttctattttccctaccccgctcctgacatcagccatttctccaaagagtcctggttcatattagtggagaatggtatttaaaaccaagatccggatgctaaaggctgtgctcattgcccctgtgctagcattgccactgtgcgttctcccagtggacaaatttggaaatatatgcgtctatgcttgttacctcatccatccatatatatattaaaaacaagtacacactgatacctatttcacatctactccacagagtttattctagtcttctccctttccacaattgtatcttctccaccctatatttaaaaactggacttccagagtctccaatacattggcttatttgttcattttccctgtgattaaccaacctcctgaccacgtggctggctcctttgctccatctctgcccctcaccccctaccgtacatcactgctgtgaggaccaagtttcctccctttcctcgatccatgacagcacctgccagttgaaccccacagtgggaattttaaagaaggcacttttggctcagatggcagtgccaaagcaggcattccaattcacatggtgctctagcaattgtgaaataaacagattctgaaggtc

SEQ ID NO: 120081 - DNA, 806 bp, Homo sapiens
  Payload ID: 3551
  Gene Symbol: CPSF2
  Gene Name: cleavage and polyadenylation specific factor 2, 100kDa
  ENST ID: ENST00000555244
  CDS Start-End: 1-806
cagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcaga

SEQ ID NO: 120082 - DNA, 715 bp, Homo sapiens
  Payload ID: 3551
  Gene Symbol: CPSF2
  Gene Name: cleavage and polyadenylation specific factor 2, 100kDa
  ENST ID: ENST00000553427
  CDS Start-End: 474-715
agtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgaggcaagtgagggcgggagaaaggagcgagcctcgggctggggaaggcggcgtcattggccctccgggagcacggggccccgactccgacccggtctcccccgaggactcgcccccgccgcttcggctgcgactgtcccggtcgttcccggcagaagtggtcagcgagggaaagagaagtgacttctccatgggtttcaagctcccagctgttttgcggcagcccattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaa

SEQ ID NO: 120083 - DNA, 558 bp, Homo sapiens
  Payload ID: 3551
  Gene Symbol: CPSF2
  Gene Name: cleavage and polyadenylation specific factor 2, 100kDa
  ENST ID: ENST00000554290
  CDS Start-End: 238-426
aaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaatctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatgga

SEQ ID NO: 120084 - DNA, 2345 bp, Homo sapiens
  Payload ID: 3552
  Gene Symbol: CPSF3
  Gene Name: cleavage and polyadenylation specific factor 3, 73kDa
  Uniprot ID: Q9UKF6
  ENST ID: ENST00000238112
  CDS Start-End: 207-2261
accccaagtggtgggaagcctcgcgagcggcgtcccccgaccggaagtcgaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagttttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctggggga

SEQ ID NO: 120085 - DNA, 3157 bp, Homo sapiens
  Payload ID: 3552
  Gene Symbol: CPSF3
  Gene Name: cleavage and polyadenylation specific factor 3, 73kDa
  ENST ID: ENST00000460593
  CDS Start-End: 1139-3082
ggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggagggtatgttggagtcggaaaaaaaaaagttttacggggccaccgctcgctttcgtacacgctaagaagcgttttcacttagcacaagcacggatctctgcgcgtcagggcaagctgtgagggagccggtgaagcttatgaccgacaggatgagaggaggacctgaatgaggctacagccgtgcagggaagaattaagtctgtttcttaacaccagggcttcacatgtgccagaagttagaaaatattagggacttgccgtgagtttcgatcttctcagctcaggccctagtagaataaggaaggtgtaaagctggagaagagaaagtgcagaggtgttagggacaaaaactcagccctcgactgtccataaggagagtggcctttcagtggacacgatcctcatcagtcgggaatgctgctgaaggggagatgcaaatgtagagaacttgaattcctacagatgagcatttcgaacccacaacatgtttattgttagatactagttggcacaacatgaatatacgctttccaaaaggtagaaagtatctcctttacacaatcattcagtaaggcttcattgagcacctgcttgggacatagtccgtttccttctgcttagttcacacctgtcatgtcttcctgtgatgagcaaacactgagcaagtgtcaagcaccacacatggggatatagacgcaacagagggcccagttaattgctctcgctcttttggagagaattacagtgcacagtgggaaatattggagagatactttggaataataggagactattactttgaagtcagacctgaagtccattatctacttgaccaattagtaggacaacaatctcactgaacccgttttctcatatggaaataagataaaacttgaagagtgaacatcgcgtggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagttttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttc

SEQ ID NO: 120086 - DNA, 871 bp, Homo sapiens
  Payload ID: 3552
  Gene Symbol: CPSF3
  Gene Name: cleavage and polyadenylation specific factor 3, 73kDa
  ENST ID: ENST00000475482
  CDS Start-End: 464-871
gacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgacccctgtaagggaccagcgagagagggaatgaagccacgggctgtgaggggcgcgaggggtaaccggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggaggtggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagttttggtgttaccatgcaggtcacgtcctaggagccgccatgttcatgattgagatcgcaggcgtgaag

SEQ ID NO: 120087 - DNA, 1839 bp, Homo sapiens
  Payload ID: 3553
  Gene Symbol: CPSF3L
  Gene Name: cleavage and polyadenylation specific factor 3-like
  Uniprot ID: Q5TA45
  ENST ID: ENST00000450926
  CDS Start-End: 63-1799
ttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctccca

SEQ ID NO: 120088 - DNA, 1832 bp, Homo sapiens
  Payload ID: 3553
  Gene Symbol: CPSF3L
  Gene Name: cleavage and polyadenylation specific factor 3-like
  ENST ID: ENST00000411962
  CDS Start-End: 66-1574
tggttgcgcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaag

SEQ ID NO: 120089 - DNA, 849 bp, Homo sapiens
  Payload ID: 3553
  Gene Symbol: CPSF3L
  Gene Name: cleavage and polyadenylation specific factor 3-like
  ENST ID: ENST00000430786
  CDS Start-End: 18-323
ggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgc

SEQ ID NO: 120090 - DNA, 1798 bp, Homo sapiens
  Payload ID: 3553
  Gene Symbol: CPSF3L
  Gene Name: cleavage and polyadenylation specific factor 3-like
  Uniprot ID: Q5TA45
  ENST ID: ENST00000419704
  CDS Start-End: 46-1545
atcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 120091 - DNA, 1056 bp, Homo sapiens
  Payload ID: 3553
  Gene Symbol: CPSF3L
  Gene Name: cleavage and polyadenylation specific factor 3-like
  ENST ID: ENST00000434694
  CDS Start-End: 23-1056
gtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtggggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaa

SEQ ID NO: 120092 - DNA, 2148 bp, Homo sapiens
  Payload ID: 3553
  Gene Symbol: CPSF3L
  Gene Name: cleavage and polyadenylation specific factor 3-like
  Uniprot ID: Q5TA45
  ENST ID: ENST00000435064
  CDS Start-End: 84-1886
ccggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagacta

SEQ ID NO: 120093 - DNA, 1618 bp, Homo sapiens
  Payload ID: 3553
  Gene Symbol: CPSF3L
  Gene Name: cleavage and polyadenylation specific factor 3-like
  ENST ID: ENST00000532772
  CDS Start-End: 21-161
ccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagc

SEQ ID NO: 120094 - DNA, 668 bp, Homo sapiens
  Payload ID: 3553
  Gene Symbol: CPSF3L
  Gene Name: cleavage and polyadenylation specific factor 3-like
  ENST ID: ENST00000527383
  CDS Start-End: 1-104
agctggagatcaaggcctactatgcaggccacgtgctgggggcagccatgttccagattaaagtgggctcagagtctgtggtctacacgagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaa

SEQ ID NO: 120095 - DNA, 2004 bp, Homo sapiens
  Payload ID: 3553
  Gene Symbol: CPSF3L
  Gene Name: cleavage and polyadenylation specific factor 3-like
  ENST ID: ENST00000527098
  CDS Start-End: 59-337
gcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctct

SEQ ID NO: 120096 - DNA, 800 bp, Homo sapiens
  Payload ID: 3553
  Gene Symbol: CPSF3L
  Gene Name: cleavage and polyadenylation specific factor 3-like
  ENST ID: ENST00000530031
  CDS Start-End: 52-800
cagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacaga

SEQ ID NO: 120097 - DNA, 1524 bp, Homo sapiens
  Payload ID: 3553
  Gene Symbol: CPSF3L
  Gene Name: cleavage and polyadenylation specific factor 3-like
  ENST ID: ENST00000528879
  CDS Start-End: 41-877
cgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaagggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacc

SEQ ID NO: 120098 - DNA, 816 bp, Homo sapiens
  Payload ID: 3553
  Gene Symbol: CPSF3L
  Gene Name: cleavage and polyadenylation specific factor 3-like
  ENST ID: ENST00000531377
  CDS Start-End: 1-165
aaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgagctgcctggattgacaagtgccgccccaacctgctcatcacagagtccacgtacgccacgaccatccgtgactccaagcgctgccgggagcgagacttcctgaagaaagtccacgagaccgtggagcgtggtgggaagggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctcc

SEQ ID NO: 120099 - DNA, 549 bp, Homo sapiens
  Payload ID: 3553
  Gene Symbol: CPSF3L
  Gene Name: cleavage and polyadenylation specific factor 3-like
  ENST ID: ENST00000531019
  CDS Start-End: 53-223
gcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaa

SEQ ID NO: 120100 - DNA, 2571 bp, Homo sapiens
  Payload ID: 3553
  Gene Symbol: CPSF3L
  Gene Name: cleavage and polyadenylation specific factor 3-like
  ENST ID: ENST00000458452
  CDS Start-End: 43-231
accgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 120101 - DNA, 584 bp, Homo sapiens
  Payload ID: 3553
  Gene Symbol: CPSF3L
  Gene Name: cleavage and polyadenylation specific factor 3-like
  ENST ID: ENST00000470679
  CDS Start-End: 1-166
tgagatcagagtcacgcccttgggggccggccaggacgtgggccgaagctgcatcctggtctccattgcgggcaagaatgtcatgctggactgtggaatgcacatgggcttcaatgacgacccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggc

SEQ ID NO: 120102 - DNA, 579 bp, Homo sapiens
  Payload ID: 3553
  Gene Symbol: CPSF3L
  Gene Name: cleavage and polyadenylation specific factor 3-like
  ENST ID: ENST00000526332
  CDS Start-End: 253-579
gcagtgcatcaccgcaggcgggcctcgcgggtccgggagcgcggcggagacgatgcctgagatcagagtcacgcccttggccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtggg

SEQ ID NO: 120103 - DNA, 659 bp, Homo sapiens
  Payload ID: 3553
  Gene Symbol: CPSF3L
  Gene Name: cleavage and polyadenylation specific factor 3-like
  ENST ID: ENST00000526797
  CDS Start-End: 51-296
agtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtggga

SEQ ID NO: 120104 - DNA, 485 bp, Homo sapiens
  Payload ID: 3553
  Gene Symbol: CPSF3L
  Gene Name: cleavage and polyadenylation specific factor 3-like
  ENST ID: ENST00000534345
  CDS Start-End: 64-485
gttgcgcctgcgcagtgcatcaccgcaggcgggcctcgcgggtccgggagcgcggcggagacgatgcctgagatcagagtcacgcccttggtaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccacca

SEQ ID NO: 120105 - DNA, 579 bp, Homo sapiens
  Payload ID: 3553
  Gene Symbol: CPSF3L
  Gene Name: cleavage and polyadenylation specific factor 3-like
  ENST ID: ENST00000525285
  CDS Start-End: 1-194
agacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagact

SEQ ID NO: 120106 - DNA, 750 bp, Homo sapiens
  Payload ID: 3553
  Gene Symbol: CPSF3L
  Gene Name: cleavage and polyadenylation specific factor 3-like
  ENST ID: ENST00000527719
  CDS Start-End: 123-750
gttgcgcctgcgcagtgcatcaccgcaggcgggcctcgcgggtccgggagcgcggcggagacgatgcctgagatcagagtcacgcccttgggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagt

SEQ ID NO: 120107 - DNA, 554 bp, Homo sapiens
  Payload ID: 3553
  Gene Symbol: CPSF3L
  Gene Name: cleavage and polyadenylation specific factor 3-like
  ENST ID: ENST00000498476
  CDS Start-End: 53-554
gcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggccccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactacc

SEQ ID NO: 120108 - DNA, 2263 bp, Homo sapiens
  Payload ID: 3553
  Gene Symbol: CPSF3L
  Gene Name: cleavage and polyadenylation specific factor 3-like
  Uniprot ID: Q5TA45
  ENST ID: ENST00000545578
  CDS Start-End: 274-1989
aagttgcagcgaggtggttgcgcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagactacttggtactctc

SEQ ID NO: 120109 - DNA, 2629 bp, Homo sapiens
  Payload ID: 3553
  Gene Symbol: CPSF3L
  Gene Name: cleavage and polyadenylation specific factor 3-like
  Uniprot ID: Q5TA45
  ENST ID: ENST00000540437
  CDS Start-End: 535-2355
aagttgcagcgaggtggttgcgcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagactacttggtactctc

SEQ ID NO: 120110 - DNA, 1868 bp, Homo sapiens
  Payload ID: 3553
  Gene Symbol: CPSF3L
  Gene Name: cleavage and polyadenylation specific factor 3-like
  ENST ID: ENST00000421495
  CDS Start-End: 587-1615
ctcgcgggtccgggagcgcggcggagacgatgcctgagatcagagtcacgcccttgggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctggggttcctggttctccgctgagcccggctgctgcagggcttaatgggacaagtggtcgcgactggactcaacctggcccgtgcgtgggctgtgcagacacgggtgttgggggtgacccggccgagtcctgccctgcagcattctcccctgtggccactgtgctgactgggccggtggtccccagggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 120111 - DNA, 1523 bp, Homo sapiens
  Payload ID: 3553
  Gene Symbol: CPSF3L
  Gene Name: cleavage and polyadenylation specific factor 3-like
  ENST ID: ENST00000618806
  CDS Start-End: 80-1249
aagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagactacttggtactctc

SEQ ID NO: 120112 - DNA, 1104 bp, Homo sapiens
  Payload ID: 3553
  Gene Symbol: CPSF3L
  Gene Name: cleavage and polyadenylation specific factor 3-like
  ENST ID: ENST00000429572
  CDS Start-End: 59-928
gcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcaccggcttatgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaactatattaggtacctatgtattttggaacatttaattttctgattgaacttgtcaaaatgaagtatgtttatcttttt

SEQ ID NO: 120113 - DNA, 1862 bp, Homo sapiens
  Payload ID: 3553
  Gene Symbol: CPSF3L
  Gene Name: cleavage and polyadenylation specific factor 3-like
  ENST ID: ENST00000620829
  CDS Start-End: 80-1588
aagttgcagcgaggtggttgcgcctgcgcagtgcatcaccgcaggcgggcctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgtgaatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagactacttggtactctc

SEQ ID NO: 120114 - DNA, 138 bp, Homo sapiens
  Payload ID: 3553
  Gene Symbol: CPSF3L
  Gene Name: cleavage and polyadenylation specific factor 3-like
  ENST ID: ENST00000627245
  CDS Start-End: 1-138
atgcctgagatcagagtcacgcccttgggggccggccaggacgtgggccgaagctgcatcctggtctccattgcgggcaagaatgtcatgctggactgtggaatgcacatgggcttcaatgacgacttgtgcttggat

SEQ ID NO: 120115 - DNA, 1691 bp, Homo sapiens
  Payload ID: 3554
  Gene Symbol: CPSF4
  Gene Name: cleavage and polyadenylation specific factor 4, 30kDa
  Uniprot ID: O95639
  ENST ID: ENST00000292476
  CDS Start-End: 11-820
cgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgtttttt

SEQ ID NO: 120116 - DNA, 687 bp, Homo sapiens
  Payload ID: 3554
  Gene Symbol: CPSF4
  Gene Name: cleavage and polyadenylation specific factor 4, 30kDa
  ENST ID: ENST00000452047
  CDS Start-End: 1-687
acagagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacgccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgt

SEQ ID NO: 120117 - DNA, 1738 bp, Homo sapiens
  Payload ID: 3554
  Gene Symbol: CPSF4
  Gene Name: cleavage and polyadenylation specific factor 4, 30kDa
  Uniprot ID: O95639
  ENST ID: ENST00000436336
  CDS Start-End: 162-896
gcgcgggctccgggcgctcccggcatccctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatt

SEQ ID NO: 120118 - DNA, 1644 bp, Homo sapiens
  Payload ID: 3554
  Gene Symbol: CPSF4
  Gene Name: cleavage and polyadenylation specific factor 4, 30kDa
  ENST ID: ENST00000451876
  CDS Start-End: 138-773
atccctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgtttttt

SEQ ID NO: 120119 - DNA, 745 bp, Homo sapiens
  Payload ID: 3554
  Gene Symbol: CPSF4
  Gene Name: cleavage and polyadenylation specific factor 4, 30kDa
  ENST ID: ENST00000412686
  CDS Start-End: 408-745
ctcttcccactccatcctgagacctcctcttctggatcccgggacgctccccttggtttcaggactcctgactcccaggcccccatttccaccgtctggggactccttttaccctcactcggactcaggagttcactgcctcggatctttggccctctgcggctgttcaaagtttcttatcatcttcagactttctggaaattgaagagacattcaaaccaaatctttgagctctttccttcggcttatccaagttaaccataggtgtgttcagatgacagacttttgttggaactgaagaaatcccaaacctagctgcctgagcagctttcttactctccaagctcacagagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgca

SEQ ID NO: 120120 - DNA, 735 bp, Homo sapiens
  Payload ID: 3554
  Gene Symbol: CPSF4
  Gene Name: cleavage and polyadenylation specific factor 4, 30kDa
  ENST ID: ENST00000430038
  CDS Start-End: 67-201
atcaagtttgacttggagatcgcggtggagcagcagctgggggcgcagccgctgcccttccccggcatggacaagtcgggcgctgctgtctgtgaattctttttgaaagctgcctgcggcaaagaagagacaggatttcaccgtgacagccaggatggtctccgtgccagccaggatggtctcgatctcctgaccttgtgatccgcccacctcggccttccaaagtgctgggattaccagcgtgatccactgcgcccggccatgagtaactattaaaatgtaaaatgtctgtcagtgtagtacctcaaatcatgttgccttctgtgagggggacctctgcccctttccaggacgtgatgccttcaggtggctccaggagttaggaagtgaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgca

SEQ ID NO: 120121 - DNA, 942 bp, Homo sapiens
  Payload ID: 3554
  Gene Symbol: CPSF4
  Gene Name: cleavage and polyadenylation specific factor 4, 30kDa
  ENST ID: ENST00000441580
  CDS Start-End: 278-853
tgggatcctcccctttagttaccgaactccctcatctgtggtcccgagactcttcccactccatcctgagacctcctcttctggatcccgggacgctccccttggtttcaggactcctgactcccaggcccccatttccaccgtctggggactccttttaccctcactcggactcaggagttcactgcctcggatctttggccctctgcggctgttcaaagagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgt

SEQ ID NO: 120122 - DNA, 578 bp, Homo sapiens
  Payload ID: 3554
  Gene Symbol: CPSF4
  Gene Name: cleavage and polyadenylation specific factor 4, 30kDa
  ENST ID: ENST00000440514
  CDS Start-End: 1-578
caagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgttgttgtctgtctctcctcttcccccacttcctgctgttcccagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgtt

SEQ ID NO: 120123 - DNA, 647 bp, Homo sapiens
  Payload ID: 3555
  Gene Symbol: CPSF4L
  Gene Name: cleavage and polyadenylation specific factor 4-like
  Uniprot ID: A6NMK7
  ENST ID: ENST00000344935
  CDS Start-End: 63-602
gctatattgggcccacctgcctgggttccagcagcttccgcagccccagcaggagacggaagatgcaagaggtcattgcggggctagagcggttcacctttgccttcgagaaggatgtcgagatgcagaagggcactgggctcctgcctttccagggcatggacaagtcggcctcagctgtgtgcaacttcttcactaaagggctctgtgagaaagggaaactctgccccttccgacatgaccgaggggagaagatggtggtatgcaagcactggctccgggggctctgcaagaagggtgatcactgcaagttcctgcaccagtatgacctcaccaggatgcctgagtgctacttctactccaagtttggtgactgcagcaacaaggagtgttccttcctccatgtgaagccagctttcaagtcccaggactgtccttggtatgaccaaggtttctgcaaggacggtcctctgtgtaaataccgccatgtccccagaataatgtgtctcaactatttagttggcttctgccccgagggacccaagtgccaatttgctcagaagattcgggaattcaagctgctgcctggaagcaagatctaagcgttgcttcttacctagcggggcactccaatgccacagacaggg

SEQ ID NO: 120124 - DNA, 1275 bp, Homo sapiens
  Payload ID: 3555
  Gene Symbol: CPSF4L
  Gene Name: cleavage and polyadenylation specific factor 4-like
  ENST ID: ENST00000397671
  CDS Start-End: 334-792
gggtgtcaggggccccagagggagaccccttccctcatgggaagaagcggggaggtgggacggctccctccctctgcaaacccccaccacccccagctctggcagaataacagccttgctgcggttggtttgtgcaactctttgctaacctgtggctgtgtcttcatggacaaagtatgagcccaggtttggtaatgtctgtgtgcacgccacgtttgtgttcggtaacatgcaaagataagcaagtcggcctcagctgtgtgcaacttcttcactaaagggctctgtgagaaagggaaactctgccccttccgacatgaccgaggggagaagatggtggtatgcaagcactggctccgggggctctgcaagaagggtgatcactgcaagttcctgcaccagtatgacctcaccaggatgcctgagtgctacttctactccaagtttggtgactgcagcaacaaggagtgttccttcctccatgtgaagccagctttcaagtcccaggactgtccttggtatgaccaaggtttctgcaaggacgcaggtcctctgtgtaaataccgccatgtccccagaataatgtgtctcaactatttagttggcttctgccccgagggacccaagtgccaatttgctcactgtagcttgccagccggccccgggattcagcacctcctatttctgctgtggaagcttggaaacccccatccccaacagagtgcctgctctcctgcctggggatcaggggtcaagggcagggcctgtgccacagggccattatgccagtaagtacagtaagactcaactgataggagttattaaaaactaacctatggtcaggagaagatgctcaatggtcttactatgggattctgtttcccaagttccacagtaagcctgctgtcatcctaagcagggtatgagtgaggtgcagaagtagcctgtggcaggcaggtttatttcttttgatcctgtaagtgaacgagctactaaaaatacaacaggtttggaggcagattggcaggaacgagttatccataaaacgggagcaaaatgtacataaaaccaaaagctcgagtctatgggaaatccacgatcattatactttgctcagctcctaccaacaggtctgggttgcacgtggcagctcctctgtatatggcttcagctgccgctatcaactggcaattaactcaaatggctttctttagcatgacagctgcttccctgtatggcttatttaaatctaagaatatactctgtaccttatgt

SEQ ID NO: 120125 - DNA, 2229 bp, Homo sapiens
  Payload ID: 3556
  Gene Symbol: CPSF6
  Gene Name: cleavage and polyadenylation specific factor 6, 68kDa
  Uniprot ID: Q16630
  ENST ID: ENST00000266679
  CDS Start-End: 32-1798
cggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggaaatttgatcaagcatcttgttaaaggaactcggcctttgttcctggaaactaggattccatggcatatggggcacagcatagaggaaatacccatttttggcctaaaagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgggg

SEQ ID NO: 120126 - DNA, 1915 bp, Homo sapiens
  Payload ID: 3556
  Gene Symbol: CPSF6
  Gene Name: cleavage and polyadenylation specific factor 6, 68kDa
  ENST ID: ENST00000456847
  CDS Start-End: 48-1484
gacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgggg

SEQ ID NO: 120127 - DNA, 6616 bp, Homo sapiens
  Payload ID: 3556
  Gene Symbol: CPSF6
  Gene Name: cleavage and polyadenylation specific factor 6, 68kDa
  Uniprot ID: Q16630
  ENST ID: ENST00000435070
  CDS Start-End: 111-1766
ctcggaagtgacgcaagcgcccccccaccgccgctagatccgctgctgctgccgcggcgggcagacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgtgtaaaaacaatccaaagagataaatccttgcatagacaccaaaaacagtgtctcagagaccttttcattttttccttagttaataactgtagtggatgtgaaaacaaacgagttgaattttaaaacatagcatttattagtgctatacagtcacattcctttcagccagtagtaaagttaaacagatgagtgatacagtacctgaatggtactgcttctgaggcaacactttggattgaaagtgctgcttttggttaaaggaactatgttgtggaaagcatattccagtgtaaatttgcagatgtgtgttttttttttttgtcacttttcataaggtttggagtaagttgcagtggcttttgatcatagtttagcccatttaatggtccttttacctagaatgttcttaagcagttaatgacaatttggaatacacagataacttgtagcttaagatactattttcatttaattctcctgtggagaatattgctttattttttactagtttcaggtcagttattaaaataaacatggaggttttaatgaatgttgtataatattttatagtgaaggaaaattgtggaaagggcaaagactttctctttcccttatgtatttaactgtgccaatctaaatacatactgttttatacaatgagatgcattacaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaacattttgttttgaaagtgtgttctttttgtcgcactgttactgcgtaacacttctcaacattctgtaagttaaattattttaaaataactatggtgaattcatgtttatttttttactttgaaaattgtagtactcaggtggtatttaatgggaaaggatcctttgggtataaatcataatgtattttaaggaatgcatctataacattgataactttagccttaaaaaaaaggtctattattccttcctctgcatcccatggtatattagcaaagtagtttacagccctgtacagccttacaaagttgttttacaatttttaatggaaagcccttaacaacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagacttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaacttttgataaga

SEQ ID NO: 120128 - DNA, 540 bp, Homo sapiens
  Payload ID: 3556
  Gene Symbol: CPSF6
  Gene Name: cleavage and polyadenylation specific factor 6, 68kDa
  ENST ID: ENST00000550075
  CDS Start-End: 76-399
agatccgctgctgctgccgcggcgggcagacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggggggagacagaatttgcaaaactctgtcacccaggctggagtgcagtggtgtaatcatagctcactgaagcctcaaactcctgggctgaagtgattctcctgtgtcagcctccaagtagctaggaccacagtggacaacagatgaagacttaactgaagcagttcattctttgggagtaaatgatattttggaga

SEQ ID NO: 120129 - DNA, 234 bp, Homo sapiens
  Payload ID: 3556
  Gene Symbol: CPSF6
  Gene Name: cleavage and polyadenylation specific factor 6, 68kDa
  ENST ID: ENST00000551516
  CDS Start-End: 6-176
ggaagatggcggacggcgtggaccacatagacatttacgcggatgtcggcgaagagttcaaccaggaagctgaatatgagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgt

SEQ ID NO: 120130 - DNA, 3695 bp, Homo sapiens
  Payload ID: 3557
  Gene Symbol: CPSF7
  Gene Name: cleavage and polyadenylation specific factor 7, 59kDa
  Uniprot ID: Q8N684
  ENST ID: ENST00000340437
  CDS Start-End: 82-1626
aacgggggcgcgcggtcgggggcaggttgggccggaagaggggtccgggccggcactgaggcgggaagggggtcggttgagatgggacggccggagtctgcgggcggagggagtcgcgggccttttgagggaggaggcagagcgcgccgggccggtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggattctgca

SEQ ID NO: 120131 - DNA, 3650 bp, Homo sapiens
  Payload ID: 3557
  Gene Symbol: CPSF7
  Gene Name: cleavage and polyadenylation specific factor 7, 59kDa
  Uniprot ID: Q8N684
  ENST ID: ENST00000394888
  CDS Start-End: 174-1589
atgccggaagtggcggtgcgtgtgacgccggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatgg

SEQ ID NO: 120132 - DNA, 574 bp, Homo sapiens
  Payload ID: 3557
  Gene Symbol: CPSF7
  Gene Name: cleavage and polyadenylation specific factor 7, 59kDa
  ENST ID: ENST00000450000
  CDS Start-End: 138-574
atattcccggtaacgggggcgcgcggtcgggggcaggttgggccggaagaggggtccgggccggcactgaggcgggaaggggtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctacc

SEQ ID NO: 120133 - DNA, 567 bp, Homo sapiens
  Payload ID: 3557
  Gene Symbol: CPSF7
  Gene Name: cleavage and polyadenylation specific factor 7, 59kDa
  ENST ID: ENST00000449811
  CDS Start-End: 137-567
gagtaggcctgggttgggggcagaggcggctggagctgcttgacacctgggggctctggccggagccgccttgggggctagtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaact

SEQ ID NO: 120134 - DNA, 727 bp, Homo sapiens
  Payload ID: 3557
  Gene Symbol: CPSF7
  Gene Name: cleavage and polyadenylation specific factor 7, 59kDa
  ENST ID: ENST00000413232
  CDS Start-End: 114-727
ctgcgggcggagggagtcgcgggccttttgagggaggaggcagagcgcgccgggccggtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcg

SEQ ID NO: 120135 - DNA, 3524 bp, Homo sapiens
  Payload ID: 3557
  Gene Symbol: CPSF7
  Gene Name: cleavage and polyadenylation specific factor 7, 59kDa
  Uniprot ID: Q8N684
  ENST ID: ENST00000439958
  CDS Start-End: 157-1545
gcgtgtgacgccggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtc

SEQ ID NO: 120136 - DNA, 1749 bp, Homo sapiens
  Payload ID: 3557
  Gene Symbol: CPSF7
  Gene Name: cleavage and polyadenylation specific factor 7, 59kDa
  Uniprot ID: Q8N684
  ENST ID: ENST00000448745
  CDS Start-End: 70-1458
tccgaatcccgcagtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaat

SEQ ID NO: 120137 - DNA, 571 bp, Homo sapiens
  Payload ID: 3557
  Gene Symbol: CPSF7
  Gene Name: cleavage and polyadenylation specific factor 7, 59kDa
  ENST ID: ENST00000413184
  CDS Start-End: 157-571
gacttttccgtcgcgccataggcagctgcggcgcagacgcggcgctacccgggtcgggcccgagggtgatgggcagcgacccccggcggcctgggagagcgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtcc

SEQ ID NO: 120138 - DNA, 598 bp, Homo sapiens
  Payload ID: 3557
  Gene Symbol: CPSF7
  Gene Name: cleavage and polyadenylation specific factor 7, 59kDa
  ENST ID: ENST00000536548
  CDS Start-End: 92-397
atattcccggtaacgggggcgcgcggtcgggggcagtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctgaggacgtactggtgccgaagaaagcaatgattaatggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccaggg

SEQ ID NO: 120139 - DNA, 722 bp, Homo sapiens
  Payload ID: 3557
  Gene Symbol: CPSF7
  Gene Name: cleavage and polyadenylation specific factor 7, 59kDa
  ENST ID: ENST00000544585
  CDS Start-End: 65-722
atattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctc

SEQ ID NO: 120140 - DNA, 546 bp, Homo sapiens
  Payload ID: 3557
  Gene Symbol: CPSF7
  Gene Name: cleavage and polyadenylation specific factor 7, 59kDa
  ENST ID: ENST00000536145
  CDS Start-End: 56-361
tggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggcagggtcatctgagggacgagatttcagagtgaacaccttgaactcttggtggtcattagatggtcctgtgataatgtggaccacagaccagcagctgatccaggttattcgctctataggagtctatgatgtggtggagttgaaatttgcagagaatcgagcaaatggccagtccaaagggtatgctgaggtggtggtagcctctgaaaactctgtc

SEQ ID NO: 120141 - DNA, 1234 bp, Homo sapiens
  Payload ID: 3557
  Gene Symbol: CPSF7
  Gene Name: cleavage and polyadenylation specific factor 7, 59kDa
  ENST ID: ENST00000477890
  CDS Start-End: 111-1234
ggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatggtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcatcgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgatta

SEQ ID NO: 120142 - DNA, 953 bp, Homo sapiens
  Payload ID: 3557
  Gene Symbol: CPSF7
  Gene Name: cleavage and polyadenylation specific factor 7, 59kDa
  ENST ID: ENST00000539952
  CDS Start-End: 90-953
attcccggtaacgggggcgcgcggtcgggggcagtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttcccc

SEQ ID NO: 120143 - DNA, 646 bp, Homo sapiens
  Payload ID: 3557
  Gene Symbol: CPSF7
  Gene Name: cleavage and polyadenylation specific factor 7, 59kDa
  ENST ID: ENST00000544990
  CDS Start-End: 50-358
cttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccct

SEQ ID NO: 120144 - DNA, 801 bp, Homo sapiens
  Payload ID: 3557
  Gene Symbol: CPSF7
  Gene Name: cleavage and polyadenylation specific factor 7, 59kDa
  ENST ID: ENST00000537162
  CDS Start-End: 131-436
cgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctgaggacgtactggtgccgaagaaagcaatgattaatggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggc

SEQ ID NO: 120145 - DNA, 495 bp, Homo sapiens
  Payload ID: 3557
  Gene Symbol: CPSF7
  Gene Name: cleavage and polyadenylation specific factor 7, 59kDa
  ENST ID: ENST00000543545
  CDS Start-End: 30-311
tccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccat

SEQ ID NO: 120146 - DNA, 940 bp, Homo sapiens
  Payload ID: 3557
  Gene Symbol: CPSF7
  Gene Name: cleavage and polyadenylation specific factor 7, 59kDa
  ENST ID: ENST00000535222
  CDS Start-End: 121-423
ggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggggtcatctgagggacgagatttcagagtgaacaccttgaactcttggtggtcattagatggtcctgtgataatgtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcc

SEQ ID NO: 120147 - DNA, 549 bp, Homo sapiens
  Payload ID: 3557
  Gene Symbol: CPSF7
  Gene Name: cleavage and polyadenylation specific factor 7, 59kDa
  ENST ID: ENST00000541963
  CDS Start-End: 91-387
agtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagt

SEQ ID NO: 120148 - DNA, 306 bp, Homo sapiens
  Payload ID: 3557
  Gene Symbol: CPSF7
  Gene Name: cleavage and polyadenylation specific factor 7, 59kDa
  ENST ID: ENST00000626926
  CDS Start-End: 1-306
atgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctga

SEQ ID NO: 120149 - DNA, 4290 bp, Homo sapiens
  Payload ID: 3558
  Gene Symbol: CSTF1
  Gene Name: cleavage stimulation factor, 3' pre-RNA, subunit 1, 50kDa
  Uniprot ID: Q05048
  ENST ID: ENST00000217109
  CDS Start-End: 353-1648
aacggccagccagacctgtggcagtcccagccccagggtgctctccgcggtcggccatttatcggtgaagcaacagccccttgacgtcaagcttgacgcattggagataaagtccaaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtggttttaagtcttcagttctcgtcagcatgaactaacttctcatcatggaggcacatagtaactgcattctcagaagatttatgcagttaaccaattgatacaagttttctttttcttgaatttttttttttttaattgaggcacagtcttgctctgtcacccaggttggagtgcagtggcgtgatctcagctcactgcaagctccgcctcctggtttcacaccattttcctgcctcagcctcccaagtagctgggactacaggcacccaccaccacgcccggctaattttttttttttttttttttttttttgtatttttagtagagccagggtttcaccatgttagccaggatggtctctatctcctgacctcgtgatccgcctgcctcagcctcccaaagttttgggattacaggcgtgagccaccgcgcccagccttcctgaagctttttagaacatgacagtacttctctggattcagcactagcagagtcagagaactctgaactccccttgtacaaacataaactttgctttatatttatcccaaaaaacaaataccttatgatctgcataggagtacctagaaatataatctgggatcatttgataaaaatagtaaatagattgaagtaaaagtcattgctttatattataggaagttttgttttgttttgttttgtttgttttgtttttgagacggagtttcgctcttgtcccccaggctttagtgcaatggcgcgatctcggctcaccgcagcctccgccacctgggttcaaacgattctcctgcctcaggctcccgagtaactaggattacaggcgtgcgccaccatgcccggctaattttgtattttttttagtagagacggggtttctccatgttggtcaggctggtctcgaactcccaacctcaggtaatccgcccgcctcagcctcccaaagtgctaggattacaggcgtgagccaccacgcgcggccccatcatacgaagttactgaagttattgcgtaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgtttccctattattctgctttgactcacatactaaaatgaccacatggcactccattgaatcttttcagttgttcacgaattaaaataatgcccatgttttacagtttttcgagtagtctcagcaatggatctgtagtttcaggacctgtttttaaaagatcaagatacttttatgtgtttcagaagtagctgttttttcattttttgtgggtttgttttttttgtgtttgtttggttggttggtttttggtttttttgctttttaaaggtcacagtgttgtgagcctggtgtaaatgccaggaatattatatggacttagtatctgcatctcgttaattgtaccacacaacactctgccattcaaataatgaatatctggtcaggatacgaacttataccctctgtgtgttttttttttttaagatacgtgatttctgaaataaactttatatacaatgataagcta

SEQ ID NO: 120150 - DNA, 1236 bp, Homo sapiens
  Payload ID: 3558
  Gene Symbol: CSTF1
  Gene Name: cleavage stimulation factor, 3' pre-RNA, subunit 1, 50kDa
  ENST ID: ENST00000415828
  CDS Start-End: 201-1236
aagaacccggaagtggtggagccaacggccagccagacctgtggcagtcccagccccagggtgctctccgcggtcggccatttatcggtgaagcaacagccccttgacgtcaagcttgacgcattggagataaagtccaaggaggtgaactaacctttgaacgtgccactggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgg

SEQ ID NO: 120151 - DNA, 554 bp, Homo sapiens
  Payload ID: 3558
  Gene Symbol: CSTF1
  Gene Name: cleavage stimulation factor, 3' pre-RNA, subunit 1, 50kDa
  ENST ID: ENST00000428552
  CDS Start-End: 129-554
gtggcagtcccagccccagggtgctctccgcggtcggccatttatcggtgaagcaacagccccttgacgtcaagcttgacgcattggagataaagtccaaggaggtgaactaacctttgaacgtgccaatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggcc

SEQ ID NO: 120152 - DNA, 1233 bp, Homo sapiens
  Payload ID: 3558
  Gene Symbol: CSTF1
  Gene Name: cleavage stimulation factor, 3' pre-RNA, subunit 1, 50kDa
  ENST ID: ENST00000452950
  CDS Start-End: 198-1233
ggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaagctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgg

SEQ ID NO: 120153 - DNA, 2234 bp, Homo sapiens
  Payload ID: 3558
  Gene Symbol: CSTF1
  Gene Name: cleavage stimulation factor, 3' pre-RNA, subunit 1, 50kDa
  ENST ID: ENST00000493039
  CDS Start-End: 166-345
gagcgggataccaagagaaccggaccagctggtactgggacacggggagagtagctggtgcggtcggctggggcatttagagaaaaccacagaaacgactggggcgagactggaagagtcgagagttagcaagctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggtagattgtgaacacaaatccatacgtcccatggcaaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgc

SEQ ID NO: 120154 - DNA, 929 bp, Homo sapiens
  Payload ID: 3558
  Gene Symbol: CSTF1
  Gene Name: cleavage stimulation factor, 3' pre-RNA, subunit 1, 50kDa
  ENST ID: ENST00000490539
  CDS Start-End: 52-231
aagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggtagattgtgaacacaaatccatacgtcccatggcaaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactgga

SEQ ID NO: 120155 - DNA, 1958 bp, Homo sapiens
  Payload ID: 3559
  Gene Symbol: CSTF2
  Gene Name: cleavage stimulation factor, 3' pre-RNA, subunit 2, 64kDa
  Uniprot ID: P33240
  ENST ID: ENST00000372972
  CDS Start-End: 17-1750
ccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaa

SEQ ID NO: 120156 - DNA, 2074 bp, Homo sapiens
  Payload ID: 3559
  Gene Symbol: CSTF2
  Gene Name: cleavage stimulation factor, 3' pre-RNA, subunit 2, 64kDa
  ENST ID: ENST00000415585
  CDS Start-End: 59-1852
ggcttgtgctccgtacggaagtgtgctttggcgcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggaatgcatgtcaatggcgcacctcctctgatgcaagcttctatgcagggtggagttccagcaccagggcaaatgccagctgctgtcacaggacctggccctggttccttagctcctggaggaggaatgcaggctcaggttggaatgccaggaagtggaccagtgtccatggaacgggggcaaggaaccctacagcactcgcccgtgggacccgccgggcctgcatcaattgagcgagttcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgc

SEQ ID NO: 120157 - DNA, 757 bp, Homo sapiens
  Payload ID: 3559
  Gene Symbol: CSTF2
  Gene Name: cleavage stimulation factor, 3' pre-RNA, subunit 2, 64kDa
  ENST ID: ENST00000413437
  CDS Start-End: 83-757
atgaatcgctaccggagccgctgacggttcggacgtgcagttctccctgcttatcctgtagggcgtccaacctggtggactcatgagcaaagagatattcccattctgccgagtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttg

SEQ ID NO: 120158 - DNA, 1693 bp, Homo sapiens
  Payload ID: 3559
  Gene Symbol: CSTF2
  Gene Name: cleavage stimulation factor, 3' pre-RNA, subunit 2, 64kDa
  ENST ID: ENST00000475126
  CDS Start-End: 1-1317
atggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagccttggcactggtgcccctgtcattgagtcaccttatggagagaccatcagtcctgaggatgcccctgagtccattagcaaagcagttgccagccttccaccagagcagatgtttgagctgatgaaacaaatgaagctctgtgtccagaatagtccccaggaggcacggaacatgttacttcagaaccctcaactggcttatgctttgctgcaagcacaggtagtgatgagaattgtggatccggaaattgccctgaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttgggtggagttccagcaccagggcaaatgccagctgctgtcacaggacctggccctggttccttagctcctggaggaggaatgcaggctcaggttggaatgccaggaagtggaccagtgtccatggaacgggggcaagtgccgatgcaagaccccagagcagctatgcagcggggatccttgcctgcgaatgtcccaacccctcgaggcttgttaggagatgctccgaatgatccacggggaggcactttactttctgtaactggagaggtagagcctagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtggaagggatccccgaggaatagatgcacgagggatggaggcccgagccatggaggcaagagggttagatgccagaggattagaggcccgtcccagtcatgcagggaacaggaatgcaaggagcaagtatacagggtggaagccagcctggcggctttagtcccgggcagaaccaagtcactccacaggatcatgagaaggctgctttgattatgcaggttctacaactgactgcagaccagattgccatgttgcctcctgagcaaaggcagagtatcctgattttaaaggaacaaatacagaaatccactggagcaccttgataggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaatttta

SEQ ID NO: 120159 - DNA, 4105 bp, Homo sapiens
  Payload ID: 3560
  Gene Symbol: CSTF2T
  Gene Name: cleavage stimulation factor, 3' pre-RNA, subunit 2, 64kDa, tau variant
  Uniprot ID: Q9H0L4
  ENST ID: ENST00000331173
  CDS Start-End: 43-1893
gcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctg

SEQ ID NO: 120160 - DNA, 2797 bp, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENST ID: ENST00000323959
  CDS Start-End: 141-2294
gggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtggaagctgtaggatcttatgcagaaaatcaaagaataacagctgtccgaagagtttatcaacgaggttgtgttaatccgatgatcaacattgaacagctctggagagactataacaagtatgaagagggtatcaatattcatttagctaaaaaaatgattgaagatcggagtagagattatatgaatgctagacgtgtagcaaaggaatatgagacagtaatgaaaggcttggaccgtaatgctccctcggtgcctcctcagaatactcctcaagaagctcaacaagtagatatgtggaagaaatatatacagtgggaaaagagcaaccctcttcgtacagaggatcagacccttataacaaaaagagttatgtttgcttatgaacagtgcctgcttgtgctgggccatcaccctgatatttggtatgaagctgcccagtatcttgagcagtcaagtaaactgctcgcagaaaagggagatatgaataatgccaaattatttagtgatgaagctgctaatatatatgaaagagccataagcactttattgaagaagaatatgcttctttattttgcatatgcagattatgaagagagtcgcatgaagtatgaaaaggttcacagtatatataacagacttctggcaattgaggatattgaccctaccttggtatatatccaatatatgaaatttgcacggagagcagaaggcatcaaatctggaagaatgatatttaaaaaagcaagagaagataccagaacccgccaccatgtctatgttactgcagcactcatggaatattactgtagtaaggacaaatctgttgcctttaagatttttgagctggggctaaaaaaatatggagacattccagagtatgtcctggcctatattgactatctttctcacctcaatgaggacaataatacccgagttttgtttgaacgagttttaacatctggaagccttcctcctgagaagtctggagaaatctgggcccgatttctagcatttgaaagtaatattggtgatctagctagtatactcaaagtggagaaaagacggtttacagcattcaaagaagagtatgaagggaaagaaacggctttactagtagatagatacaagttcatggatttatatccttgctctgcaagtgaattaaaagcacttggttataaggatgtctcccgtgctaagctagcagctataattccggacccagttgtagctccttctatagtgcctgttctgaaagatgaagtggatagaaaaccagaataccctaaaccagacactcagcagatgattccatttcagccacgacatttagcacctccaggtttacaccctgtacctggtggagtgttcccagtccctcctgcagctgttgttttaatgaaacttctccctcctcctatctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtggtatgtttaaaagagacaacgctttgttacaaggttcttggaaacaaagttgtattgtcattggtgcctctatcacatggttcttgagaaaaaacaaaccaacctgtgtgaattttagaatacggaacagacctatgctctaagcaaaattaggttttcaaaaatgtgagaacagtacaaagtggcagaaccacattttgttccctcttcaagggtgtcttgtatgtgccgcttgaagatttgtgagtttttcaacagttttattttaaaaactggatggcttatgattgtaaagcattttatcacattttctgaaaacaattgttcttggtttgcttatgtagagtcctgccttattgtttgtttttatttatggcagaatgtatgaaatccgttttgtagtttcaaattttaaaagtcctttaaaaaataaaaggattcagaaaca

SEQ ID NO: 120161 - DNA, 1132 bp, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENST ID: ENST00000438862
  CDS Start-End: 207-518
aatgcggaagccacacacctcctcctcggccggcaggggcgcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttggagttgcaacaacattaaaacagtttcaatggtattggagtgctttagccttttatttacttgtcatgtgtcaatttattgcctcctgtgtcatttatttagaactcatttttctttttattcctacttacaaactaatatgaatgggagtatatgaaaatacagaaatgttaacttagtttttcatagagtattttgagtgtctggtgaaatgaaacattttaagagaagaattacttcacattttaattttgtgaaaatgcatggtttatcaatgtaagcacttcaataatttaacgatttttctgtaagatagtttatattatgcaagaataagctaatgtgattcaaacctatttaatcctatttaatcataattttacccaatgatactttgatatttttttcttgctttttatatcttgaaatttgaacccaggcatgtatattttaaagagtaaggaccccattcatgattatggttaggaggaaaatgtta

SEQ ID NO: 120162 - DNA, 715 bp, Homo sapiens
  Payload ID: 3561
  Gene Symbol: CSTF3
  Gene Name: cleavage stimulation factor, 3' pre-RNA, subunit 3, 77kDa
  Uniprot ID: Q12996
  ENST ID: ENST00000431742
  CDS Start-End: 167-301
gcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgcccagttccccagttctggcagattctggaaactgtacattgaagcagaggttactattttattttattttttcttatatcagtattgcagcattcactgtagtgatagaaaacaagttaggaacatagccaattaggacaaggaggatttaaatgtgtcttacctttattttgtaaaataggtataaaggagtaattaaaatgaatttttgaaatttgggtcttttacaagctgatgattgttgcattttg

SEQ ID NO: 120163 - DNA, 693 bp, Homo sapiens
  Payload ID: 3561
  Gene Symbol: CSTF3
  Gene Name: cleavage stimulation factor, 3' pre-RNA, subunit 3, 77kDa
  ENST ID: ENST00000524827
  CDS Start-End: 136-693
gtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggtagagacgaggtctcactgtgtttcccaggctggtcttgaactcctggacttaagtgatcctcctgcctcagccttccaaactgttggattacaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagagattaaagctaaaaattatgacaaggttgaaaagctatttcagagatgccttatgaaggttttgcacattgatttatggaagtgttatctttcatatgtccgagaaaccaagggtaaactaccaagttacaaagaaaaaatggctcaagcatatgactttgcactggataaaattggaatggaaattatgtcctatcagatttgggtggattacatcaatttcctaaaaggcgtgtaa

SEQ ID NO: 120164 - DNA, 434 bp, Homo sapiens
  Payload ID: 3561
  Gene Symbol: CSTF3
  Gene Name: cleavage stimulation factor, 3' pre-RNA, subunit 3, 77kDa
  ENST ID: ENST00000524775
  CDS Start-End: 251-434
accgtattagccaggatggtctcatctcctgaccttgtgatccgcccgcctcagcctcccaaagtgctgcgattacaggcgtgagccaccgcacctggcctagaactcctgactttaaatgatccatccgttttggcctcccaaactgctgggattacaggcgtgggccaccgcgcccagtcaatctcatttaatcttaatgccagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttcc

SEQ ID NO: 120165 - DNA, 558 bp, Homo sapiens
  Payload ID: 3561
  Gene Symbol: CSTF3
  Gene Name: cleavage stimulation factor, 3' pre-RNA, subunit 3, 77kDa
  ENST ID: ENST00000524556
  CDS Start-End: 171-329
gggcgcagccattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcagacagggtctggctctgtcacccaggcccgagtgcagtggcggcaatctcagttccctgcaacttctccctcccgggctcaagcgatcccaccgcagcttcccaagcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcagaggttactattttattttattttttcttatatcagtattgcagcattcactgtagtgatag

SEQ ID NO: 120166 - DNA, 592 bp, Homo sapiens
  Payload ID: 3561
  Gene Symbol: CSTF3
  Gene Name: cleavage stimulation factor, 3' pre-RNA, subunit 3, 77kDa
  ENST ID: ENST00000528865
  CDS Start-End: 1-274
ctgtttccagggtccttttgtacaagtggatgaactgatggaaattttccgaagatgcaagataccaaatactgttgaggaagctgtgaggatcattactggtggggccccagagctagctgtagaaggcaacggccccgtggaaagtaatgcagtactcaccaaggccgtcaaaaggcccaacgaggattcagatgaagatgaagaaaagggagccgttgtcccccctgttcatgacatttacagagcacggcagcagaagcggattcggtagggttttaaacgcctctgcagaaaactcctgtccaggattccttttgcctcaagtgttgcagaactccaccagtggacaccgaggtagtgggcggccaagagtctgtgaagccagttattcatgcatcaagatttcaaacggtccaaatggaactctggcaatgtaagaactcaggaggggaaaaatatcttgcaagaatctactcttacaaaagaagagtttttgagatttaggaagaatgactgcaggaagtggtgatcagcgctgtgcagttggggttaagctcctctccttcagccttggagcggcaggaaaagg

SEQ ID NO: 120167 - DNA, 2604 bp, Homo sapiens
  Payload ID: 3562
  Gene Symbol: CLPTM1
  Gene Name: cleft lip and palate associated transmembrane protein 1
  Uniprot ID: O96005
  ENST ID: ENST00000337392
  CDS Start-End: 151-2160
aagtggccttcctgagaggcgtggctgcggcactcttgccggatagggtggcccggcggggctaggaaagcgtgaaatctcgcgcgattgcgctgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 120168 - DNA, 2732 bp, Homo sapiens
  Payload ID: 3562
  Gene Symbol: CLPTM1
  Gene Name: cleft lip and palate associated transmembrane protein 1
  Uniprot ID: O96005
  ENST ID: ENST00000541297
  CDS Start-End: 466-2433
aaactaagggtctctcagcagatggccgggtttagagctgtacgaagacacacagctaatgaaaaattgtggaattctcagagcccgtgaagcctagcccacggatgcgaggtttggaccactgagggaacgcgcatgcgtgctaggcagggcagtccgaaggcttgggggtgtatcatagggtctcatcggaggtttgttggccgtaagacccctggaattggaactctaaaaacacagaaaggatatgagctcaggagacttgaacgaaagagttgtcttaggaagaggggtcagaagacaagggtgctgggcaaaaggctagttcttcgaatcagaatacggtggccagaaaggttcctctgacgaaagaggggcgtggttcgaagccgtacagtggccggtaaagctcaagaaacatggaacgaaaaggacgcgaagaatcggcagggagaagcggacaggatgtcccgaaaggctcatataaccgaaaaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgg

SEQ ID NO: 120169 - DNA, 2342 bp, Homo sapiens
  Payload ID: 3562
  Gene Symbol: CLPTM1
  Gene Name: cleft lip and palate associated transmembrane protein 1
  Uniprot ID: O96005
  ENST ID: ENST00000546079
  CDS Start-End: 346-2049
aaactaagggtctctcagcagatggccgggtttagagctgtacgaagacacacagctaatgaaaaattgtggaattctcagagcccgtgaagcctagcccacggatgcgaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggtt

SEQ ID NO: 120170 - DNA, 638 bp, Homo sapiens
  Payload ID: 3562
  Gene Symbol: CLPTM1
  Gene Name: cleft lip and palate associated transmembrane protein 1
  ENST ID: ENST00000589347
  CDS Start-End: 1-459
ccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatgcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctac

SEQ ID NO: 120171 - DNA, 572 bp, Homo sapiens
  Payload ID: 3562
  Gene Symbol: CLPTM1
  Gene Name: cleft lip and palate associated transmembrane protein 1
  ENST ID: ENST00000585961
  CDS Start-End: 518-572
gcactgggggctccttggccagagggaccttgaatacccggcccaggcagggccggaccgcccgggaggccggacggtgccgggaacagggccctgttgcgggtcggttcccctgcacgctcgagccgggcggccaccaggctcattgctcgatccggggagacagtggctcggaggggcgcaggcttgtaccttggcgcgctgggttctcaactccgcgattccatgctctgaggccgttcctagagtggtctggcgttcaggtctcgttgtagtgtttgaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgaacctgcatgtgtacatctcagagcacgagcactttacagacttcaacgcca

SEQ ID NO: 120172 - DNA, 528 bp, Homo sapiens
  Payload ID: 3562
  Gene Symbol: CLPTM1
  Gene Name: cleft lip and palate associated transmembrane protein 1
  ENST ID: ENST00000591304
  CDS Start-End: 16-528
acccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagctccacgcgtcgccagccgcaacctgttccccaaagacactttaatgagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaag

SEQ ID NO: 120173 - DNA, 775 bp, Homo sapiens
  Payload ID: 3562
  Gene Symbol: CLPTM1
  Gene Name: cleft lip and palate associated transmembrane protein 1
  ENST ID: ENST00000586915
  CDS Start-End: 1-630
tacaagctcaagtctgtggcccaccttccctggcgcatgctcacctacaaggccctcaacacattcatcgacgacctgttcgcctttgtcatcaagatgcccgttatgtaccggatcggctgcctgcgggacggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggc

SEQ ID NO: 120174 - DNA, 2234 bp, Homo sapiens
  Payload ID: 3563
  Gene Symbol: CLASRP
  Gene Name: CLK4-associating serine/arginine rich protein
  ENST ID: ENST00000221455
  CDS Start-End: 99-2123
gcggcctttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 120175 - DNA, 2213 bp, Homo sapiens
  Payload ID: 3563
  Gene Symbol: CLASRP
  Gene Name: CLK4-associating serine/arginine rich protein
  Uniprot ID: Q8N2M8
  ENST ID: ENST00000391952
  CDS Start-End: 74-1858
gcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtca

SEQ ID NO: 120176 - DNA, 1941 bp, Homo sapiens
  Payload ID: 3563
  Gene Symbol: CLASRP
  Gene Name: CLK4-associating serine/arginine rich protein
  Uniprot ID: Q8N2M8
  ENST ID: ENST00000391953
  CDS Start-End: 93-1931
tttcatttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaacccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagt

SEQ ID NO: 120177 - DNA, 2769 bp, Homo sapiens
  Payload ID: 3563
  Gene Symbol: CLASRP
  Gene Name: CLK4-associating serine/arginine rich protein
  ENST ID: ENST00000544944
  CDS Start-End: 693-2660
ctctttttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccgccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagaccgaacctgccgctggtaaagagacaggagctgccaaagtcatcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgt

SEQ ID NO: 120178 - DNA, 590 bp, Homo sapiens
  Payload ID: 3563
  Gene Symbol: CLASRP
  Gene Name: CLK4-associating serine/arginine rich protein
  ENST ID: ENST00000588936
  CDS Start-End: 331-590
gcgcgagcgcagcggtgggaggcggcgaccagccgcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctgga

SEQ ID NO: 120179 - DNA, 572 bp, Homo sapiens
  Payload ID: 3563
  Gene Symbol: CLASRP
  Gene Name: CLK4-associating serine/arginine rich protein
  ENST ID: ENST00000591410
  CDS Start-End: 89-334
atttccgcttccggtgcgggccgcgcgcgagcgcagcggtgggaggcggcgaccagccggttgaggccccaggcttggcctcaccacaatgtggcacgaggctcggaagcatgagcggaagcttcgaggcatgatggtcgactacaagaagagggcggagcggagacgggagtattatgaaaagatctctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgaggtcatccccgacatcgacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctct

SEQ ID NO: 120180 - DNA, 867 bp, Homo sapiens
  Payload ID: 3563
  Gene Symbol: CLASRP
  Gene Name: CLK4-associating serine/arginine rich protein
  ENST ID: ENST00000587112
  CDS Start-End: 1-567
aagaagagggcggagcggagacgggagtattatgaaaagatcaagaaggacccagcccagttcctgcaggtacatggccgagcttgcaaggtgcacctggattctgcagtcgccctggccgctgagagccctgttaatatgatgccctggcagggggacaccaacaacatgattgaccgattcgatgtccgtgcccacctggaccacatccccgactacaccccccctctgctcaccaccatctccccagaacaggagtcggacgaacggaagtgtaactacgagcgctacagaggcctggtgcagaacgactttgccggcatctcagaggagcagtgcctgtaccagatctacattgatgagttgtacggaggcctccagagacccagcgaagatgagaagaagaagctggcagagaagaaggcttccatcggttatacctacgaggacagcacggtggccgaggtagagaaggcggcagaaaagccagaggaggaggagtcagcggccgaggaggagagcaactcggacgaagatgagacgtggaggtggacgtggatgaattgaaccaggagcaggtggcagatctcaacaaacaggccacgacttatggcatggccgacggtgacttcgtcaggatgctccggaaagacaaggaggaggcagaggccatcaagcatgccaaggctcttgaggaggagaaggccatgtactcgggacgccgctctcgacgccagcggagagagtttcgggagaagcggctgaggggtcgcaagatcagcccacccagctatgcccgccgagacagccccacctatgacccctataagcggtcaccctcggagtccagctcagagtcccgctccc

SEQ ID NO: 120181 - DNA, 506 bp, Homo sapiens
  Payload ID: 3563
  Gene Symbol: CLASRP
  Gene Name: CLK4-associating serine/arginine rich protein
  ENST ID: ENST00000591904
  CDS Start-End: 1-396
cccaagctgacgcctcaggagaagctgaaactgaggatgcagaaggcgctgaacaggcagttcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtc

SEQ ID NO: 120182 - DNA, 10304 bp, Homo sapiens
  Payload ID: 3564
  Gene Symbol: CLOCK
  Gene Name: clock circadian regulator
  Uniprot ID: O15516
  ENST ID: ENST00000309964
  CDS Start-End: 252-2792
agctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaaaaaaaaaaaaaagtcttccctctgctttattctcactttcttaaaaacacttattctgggtggtactttttaggtaagaaactactgagtttcaggaaaaatgctagctactctgcagttaccgtgctttggacttgcagttatcatagttttgggagagtcagtattgtttaacaaatgcaagtgagaactagaagggttaataaagttgctccttagagtggtgtcaaaccagaaccgagacacttaaaaagtacttcattttttgaatggaaaatattggagaaaagtatgggagatgcaggtagcatgtgagtaaatactacggtctagccttcgagcatcccaaattccgggggtaacttgacagtgctgtgctctcctttgtcatttatatctggcttaggaatggaatagtaataacaagatgccagtgatttggaatagtttgttatagaacattcagtgcaaaatagtgaaaatgtttggtcttcagaagtgctgtagttgttggtcattgccttaaagcagtctgcttgacgctaggagcactgaagcagtccagctccatcaagagcactgttgaagggagaagaacccttgttcaggaagccttagaaagggatccttaaaatagtactctacgcagacaagtgaaaattcttttaaactggatattactcaacatgttttcagatgtttccactacattgaggcaaactttttaaaagtggaatgcaaatagcattttactttagtatttctgcttttttctttctgtttctttggtaattgaaagtttgttgatgaatatttgtgtaaaacgcattcaagtctataacctttccaattacctgtggcccttagtcccacaggagtccctgttggaagggggtaaacactggatattaatgttgctgagtgagtctttctagccaggacaagctgattggaatttttgaatggtagagaagaaacagcacaaaggcacttgccattttaagtgtttggagaaagagaaccttttaagtttggattgggtgagctttcttctaaaaggagcttctgaagtaattgcaaaggaatagaatcgactatttttatagtatatttaatatatttgtatataactataataggaaccctctacatgcctcccacttttctaatttacttccccttttgccatagcactagtatagcctcatccgcatgggtaatgtgcctattgtcagcctaccaaaagatagtgctgctgctttatgagacaggtgagaagacccaactctcatgcctggggatcctttacggaaggaatagcacacacttttaaaacaacataccacagtctaaaagcatcattttgaaatgtaacaagcactttattgcaattactcattttgataaagtttattcttaggcgttaaccatttctaaaggatccccaaatcatcacttacttaggtgaaattatataaaatgacacatttctgagaaatgtttaggtccagtgaaccgtagttggtttatgggagtgatttcaagatagccaaatgaactttgatttttgttttgaatgtggtggagtcaagagattgtagatgcctagtttgatttaaacactattgtaaacctatcttgcctattgtgtggacaccaaaagagaccaatgagcctgtttatttttcagaggtctaggaaaattgcatccgtgtgagtagatgtacagaactaatctaaaagtgattgctagtaacattttagaatataataatttcaagaattattctgagtgttttaaatgtgccctgaaatgttggcatgtcatttcagcatttccatttgaattgctcttgtaatatttttgcacaaaaaggactgagaaaaagaatactttggttaaaggaaaaaaatagtataatttggtctttaattttaatgtctcctgtggaaacactggggatgaattttgttggcacagttattcaggatatttaaaacagtgttgaacagttcacaagaaattaagcaaacttggattttaaaaattaaaatactttctttccatgtgactgttttgcatagttttttccccctatgtcataacactacattccttgtttttcttaaataaaatactctgcaggttttgttgtgagtgtttataacagtattttgtaagctgcctgggtttcctcagggaaacattatttagtggaataggatatagtttatggagagacaactaagtgaaattccatcaccaccaccagcaaacactgaggtgctgcattaagtgacaatcaaactagtaagtatttatgaaagaatttagaaaggggttcaaagaagcaattgcttttaaagcagttctctggggttcttgaataaaaatggctaaatgtatttatttatattttaaaatacctgtgtgttctgttttctcatcaaagtgatttcggtgtcatgtatttaatgtgtggtttgttttgttttgcaccatattcttcttagggaactggctctgatttggggtgcagtcaccaactctcatgataatctttacggacagtctgaatctactttacttcaggacggcagtggaggggccaactccagatgcccctgcacttccctcctcaagtcatctaagaaagaattttagaaataactcctttcaaatctgattcatacagttccaacctttttctagtttcacttgctgccttctttgttttatgggcactttttgtgtgattacttccccaacacagtcaaaggccagtatgacagaaccaatggcacatgatgcctctattttgcccatttggggaaatgttagtaaaagaaatagcatcttttaatggctgtcattatcatatccatattaaaatccatttaaagttcttaaatttggcggaataatgtatacaggctgtaaacttctacaaaaaatgtttgctgtctttaatatggtgtcaagttacttggtcctttgaaaacaaaacaaaacttccatacacagcactgcccagtaaagcagtgttggaatattggaaacctagacatttgaggatccttcttgctcacaagcattggaacagaatcctccactttaggactcagagaagctatggagtcccacaggctaggtatagcacacaacttagagaacggtagttaaagcacgtcaaccacaattgaatttaatgatctaaaaaatatttcttaactctgagggttaaactgaagatacgttttcaaataaaagcttttaaatttcttaggaaacaaactgtgacatcgcttttaaaaatgacattcaaatgtttataatgtgtgtttttgagttggcttggactagtgcaagttcactgctggcaatggttatgccagtagttaagttaaaataagttgttaccttcagattgatgtcttgtataaccagacaatcatcttcaagcaaaaaaattggccaggaaatgtctttttaaaaaaaaaaaaaaaaaaaaagatgtgtcagccagaacagttaccattcagaccatactggaatgattttgaaatctttactatggtttaagttggggaaggcctcagtatggcattttcatattcactctatgtaaagattgaagcccaaagatgagttaaattcagtgctgtattgaaaccagtcagtgcaaaaaaaaaaaaaaagttttacctttgtaaatttttcattgttaacatcagttggtagttgttaaaacatgcaccaaattctttataatgttctgtgtggttctcaatgtgatattcttgacattgctgtccttactgcttggttcttggttttaaattaaaaagtagatgtagctcatcatttttacttccaaaacggtggagctaaaaacggctaattgatcttgagataagaataccctttactaaggcaaagatttaattgaaatccaaaatgatttatagaaacgaaaggcattttccatttgttgtcttctgccgaaattctgaattgcatacacacatgaaggataatgaatggtttcaacggtgctatattaggttctctgattttcatgacctatgtatgtttggaaatacaatattgtataaaatgtggatcgttttgttaccgatttaatattgccattttaatttggtgtaacaattggttacacttgtttttcaaagctatcctttgaggagaaagtcaaaatgtgttgttagcctacctccactcaggcctcttgctgtgtaatcattattccaggttatgatgtgcatagcttttaaaactgcgtgtactattattctgctctttcccatactcttgtcatgtattcagaacctaaacttatagcaaaagagccaagcagtagcagtttttgtaaatgtaaaaataattagatccagactttgtttccttcaattttaaaaataaaaaatacctcagtgctatgtttttcagttatcacctgcatttctcaaaaaataacacctgcttcatgtggcacataacttgtaagaatcacattttggattttaaagaaagactattaaatattttaagatcactatcaa

SEQ ID NO: 120183 - DNA, 4059 bp, Homo sapiens
  Payload ID: 3564
  Gene Symbol: CLOCK
  Gene Name: clock circadian regulator
  Uniprot ID: O15516
  ENST ID: ENST00000381322
  CDS Start-End: 927-3467
gtctgactccagcgaccgcgcgcgggttcgagggttggcggcgaggcgctcggtttctcttcttccgtccacccgcgcttcccgttccccgtcaccgccgctggcgtttgtagatttctttccgccagtgaagctgggttttctggagttggctctggcgctctggcccctggagtgtaatttcctacacgcagcgccgcagagtttatattctttgaaagtgtttgtagctttgtagaggtcctcttgttgatggtaggtgagcctaattctgcaagataaaagcctagtctctgacctggcagatgaaagatcaaatcagattgtggtttcctgctattagaatgccgtgctattagactttaaggctttttagccttctttaaaaaataaaaaaatttttacagtggaagaaaagcacaagaagtaaacttttacagtcgttgatttgactataacgctgatccccccaaatcaaagaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggcagttattggaggaattactcaacaaaaataaagaagtaaactaaaaaagatgaaggcataggatacaagtaacagggaatatgacctaactagagacccagggaatcaccaggatgatgatgaataatgatcacaagaagacagcttgtcctcaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaa

SEQ ID NO: 120184 - DNA, 746 bp, Homo sapiens
  Payload ID: 3564
  Gene Symbol: CLOCK
  Gene Name: clock circadian regulator
  ENST ID: ENST00000435527
  CDS Start-End: 201-746
cgagtcaccgcagcgggagacctgggtgggggagggaagaagccggagccgccgcaagccacacgaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaacccca

SEQ ID NO: 120185 - DNA, 3580 bp, Homo sapiens
  Payload ID: 3564
  Gene Symbol: CLOCK
  Gene Name: clock circadian regulator
  Uniprot ID: O15516
  ENST ID: ENST00000513440
  CDS Start-End: 647-3187
tttctagtaaccggcgccgttcccggccggggcagggaacggtgcgcctgcagagccagatttcggcccaaggggcgcgggagtctcttcgggcgtccgggatcccctggcgcggctccgtgctgcctaacggggcaagtcgcatgcgcaccgagccgcgctggggaaagggagagtgaggggaggggcgagcgcagagcctccgccggccgtctgagcccgcggggtcgctgacgacgcatgcgccgggagggggcgcaatcacggactcggcttgcggctgccggtttaaaaaaggaaaccccggagagcgagagcgcgaaggaaatctggccgccgccgccgcgagcgctcccgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactg

SEQ ID NO: 120186 - DNA, 4486 bp, Homo sapiens
  Payload ID: 3565
  Gene Symbol: CIPC
  Gene Name: CLOCK-interacting pacemaker
  Uniprot ID: Q9C0C6
  ENST ID: ENST00000361786
  CDS Start-End: 318-1517
cttccggcgggggcggggaaagggcgcatttccaagggcccttctaggagaacagcgtgcggtctccatggtgccgggtcatccgagtcgggtcacgtggctggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctcaggcttgggccaagctgcaggcatctttaacacctgggtccagtaatacaggcagtgacctagaagcattctctgatcacccagccatatagcacagaggcatattttcctgttacttgagtggttcttttagctcatttgctgttacctactcctgtttcccaaagcttatgtaagagcttttccttctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaacacgaatgagcatacagagcaacacctgttgagccagggagtaggtgacacaaggaaaccttcatggatcttcccttgcctgtcttagtcacagagagaaataagaggaggttgtttgcatcccacaaggcatcgtactagttgggcgagacctaaaattccctgggcacaggttgcacctgggtgtgagcacttaatcactcaacgctttgttttcttacacttgaaaatcaagggaaagagtagtaccatctgactcctacactttcattacaagtcagatttttcttaaactagcaggcaaaaacagtacttccaaattttaaggtatggaatgaatgcagtacatctggaattgtagtcgatgaattgcttttttgacttagaagctgaagaaaatagacatagccggcatatctcatggtcaggagctggacgattctggtaacttaggctttttttctctcttcttttgaaacagtgtaacctgttttatgtctaaaaatcttaaggatagtttcagtggttcctgggatgtagtataagttaactctgctgccatcttgttttttttttttttcctttattttgataagtgattattatgcttgataaactttgaattaaatacagttgtcttgagggtatgataagtccacaaaaaattggaaagcatcttacccattttcttcacatcccaaatttttatttgttccatgtcatagtgatgggaagcagttacagagcagcgtcttctgtgtttccttcatgtgttagatattggcaacaaagccagaggtgtaatgttggttatatgaagttcatctcaaaatggagaccatgaccagagtttccagatgatacacgttcttttcagcttcattaaataggcaactatgtttctaaatagtaaagtttcaaaatattctctcaatttaaaatttcatcctcttgaaaatctttgttctttacaaaattatcttaataagttctatatggtcagcttcatcttccttttttttttttttgagatggagtttcgctcttgttgcccaggcggagtacaatggtgggatctcggctcactgcaacctccgcctcctgggttcaagtgattctcctgccacagcctcccaagtagctgggattacaggtgcctgccaccatgcccagctaatttttgtatttttagtagaaatggggttttaccgtgttggccaggctggtctcgaactcctgacctcagttgatccgcctgcctcagcctcccaaagtgctgggcttacaggcctgagccaccacgctcagctcagcttcaccctgtctgcaaagaaaagttttaccaagaccagaagttaaatatgacatttcctaggtagttgtaactctaacatagtttaaaaagtatgtggcttcagattgcctatactttgttcacaaacgtgtgatttagatatgactgatgtagaagtgaacaacttggtaacatccctagactccactcatgaacgcagaattattacctgctgtttgctttctgaaagaatttcagaaatcagagcaaatgtgtctttaggcagattcagctccttttaatatttttctcttggcccactctctttgcttcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaaccta

SEQ ID NO: 120187 - DNA, 599 bp, Homo sapiens
  Payload ID: 3565
  Gene Symbol: CIPC
  Gene Name: CLOCK-interacting pacemaker
  ENST ID: ENST00000555611
  CDS Start-End: 133-444
gtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagcagtaatgagtagtgtgctgctctcctcctttgtcttcagggcagcagctcatcccagctccagtcgtggactgtccagccctcctttgaagtgatctcagcacagccacagctcttattccttcatccacctgtaccatctcctgtcagtccatgtcaca

SEQ ID NO: 120188 - DNA, 581 bp, Homo sapiens
  Payload ID: 3565
  Gene Symbol: CIPC
  Gene Name: CLOCK-interacting pacemaker
  ENST ID: ENST00000555200
  CDS Start-End: 158-581
agatgcaacgtgggctggtgcgaatgggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtc

SEQ ID NO: 120189 - DNA, 584 bp, Homo sapiens
  Payload ID: 3565
  Gene Symbol: CIPC
  Gene Name: CLOCK-interacting pacemaker
  ENST ID: ENST00000554658
  CDS Start-End: 181-584
tgcgccacctgacccacaggccggtcgtggagctgcgaccccggccctaggggaccagacgtggaggttagatcttaaggtgaccgtggtgtttggaaatgcagaatcttgaccttcaagctgttcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtacc

SEQ ID NO: 120190 - DNA, 566 bp, Homo sapiens
  Payload ID: 3565
  Gene Symbol: CIPC
  Gene Name: CLOCK-interacting pacemaker
  ENST ID: ENST00000555437
  CDS Start-End: 289-474
ttccaagggcccttctaggagaacagcgtgcggtctccatggtgccgggtcatccgagtcgggtcacgtggctggcgaaagccgtcgcggaggcgtggggaggagaaatgggcgggaggctgtggggatagcgagacacccagcgacgacgaggttgtcatggtgccgcggggccgtgctcgcgcatgcgccacctgacccacaggccggtcgtggagctgcgaccccggccctagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagggcagcagctcatcccagctccagtcgtggactgtccagccctcctttgaagtgatctcagcacagccacagctcttattccttcatccacctgtaccatctcctgtcagtccatgtcacactggtgagaaaaagtccgact

SEQ ID NO: 120191 - DNA, 596 bp, Homo sapiens
  Payload ID: 3565
  Gene Symbol: CIPC
  Gene Name: CLOCK-interacting pacemaker
  ENST ID: ENST00000554447
  CDS Start-End: 143-596
agttttgccctgctgagctggcaggctggtggatgcctggagggtgcacatgctgcctggcacagatgcaacgtgggctggtgcgaatggggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccagga

SEQ ID NO: 120192 - DNA, 882 bp, Homo sapiens
  Payload ID: 3565
  Gene Symbol: CIPC
  Gene Name: CLOCK-interacting pacemaker
  ENST ID: ENST00000557115
  CDS Start-End: 413-882
gaaagggagggctcggtccgggaggaggggagcagggatgacggcgggagagggattgggcgaggagcgtggggaaaggaggtggaagtaggggagagaggaagaggagcgagtaggcaagaggggcaaaccgggactttcggaggacggagagccaaatggtgggagcagggctttggtttgctgtgaggggcgtgggagagggaatcgcgggtgaggagggggctgcgtgtggggaggaggcttgtgtgaggggcaggtgggccctggtctagccctgggcgcaaccgccagccggctgggcggggagagagcttggagtccagcccggctgggagctgagggccaagcaatgggcagggcagtccagatgaaaagagtaccaatgaatctgcctccagctgaataaaccatggagaggaaaaacccatccagagagagccccagaagactctctgccaaagtaggcaaaggcacagagatgaagaaagtggctcgtcagcttgggatggctgctgctgagtcagacaaggactctggcttttcagatgggagctcggaatgtctgagctctgcagagcagatggagtccgaggacatgctgagcgccttaggctggagcagagaagacaggccgaggcagaactccaaaactgcaaagaatgccttccctaccctgtctcccatggtcgtcatgaagaatgtgcttgtcaaacagggcagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattct

SEQ ID NO: 120193 - DNA, 3240 bp, Homo sapiens
  Payload ID: 3566
  Gene Symbol: CLPB
  Gene Name: ClpB homolog, mitochondrial AAA ATPase chaperonin
  Uniprot ID: Q9H078
  ENST ID: ENST00000294053
  CDS Start-End: 175-2298
cgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaa

SEQ ID NO: 120194 - DNA, 2071 bp, Homo sapiens
  Payload ID: 3566
  Gene Symbol: CLPB
  Gene Name: ClpB homolog, mitochondrial AAA ATPase chaperonin
  Uniprot ID: Q9H078
  ENST ID: ENST00000340729
  CDS Start-End: 61-2007
catgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggc

SEQ ID NO: 120195 - DNA, 3379 bp, Homo sapiens
  Payload ID: 3566
  Gene Symbol: CLPB
  Gene Name: ClpB homolog, mitochondrial AAA ATPase chaperonin
  Uniprot ID: Q9H078
  ENST ID: ENST00000437826
  CDS Start-End: 449-2437
attgtgacgcaatcccacagccttctgggaaacgtagtttatttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagccccaagagactgcaaagaatgatgctcagtcaagaagctgggcagggctgaatgctggagtctcactgaagaacaccaagatttcctcctctgaatggcccctcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattcagtctgcatgttagtcacaaa

SEQ ID NO: 120196 - DNA, 2133 bp, Homo sapiens
  Payload ID: 3566
  Gene Symbol: CLPB
  Gene Name: ClpB homolog, mitochondrial AAA ATPase chaperonin
  Uniprot ID: Q9H078
  ENST ID: ENST00000543042
  CDS Start-End: 555-2075
atttattctccagctggggaaaggcttagggctgtggactacctctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtgg

SEQ ID NO: 120197 - DNA, 2047 bp, Homo sapiens
  Payload ID: 3566
  Gene Symbol: CLPB
  Gene Name: ClpB homolog, mitochondrial AAA ATPase chaperonin
  ENST ID: ENST00000535477
  CDS Start-End: 37-1542
ggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttg

SEQ ID NO: 120198 - DNA, 3078 bp, Homo sapiens
  Payload ID: 3566
  Gene Symbol: CLPB
  Gene Name: ClpB homolog, mitochondrial AAA ATPase chaperonin
  Uniprot ID: Q9H078
  ENST ID: ENST00000538039
  CDS Start-End: 124-2157
tctcccgtgaggtagtgcgcaactccaccctgttcgcggcgtcttcgaacgcgccgcggcagccatgttggacgtggtcagcacaggggccggcaccacggggttatcgaagcagctgtcaagatgctggggtccctggtgttgaggagaaaagcactggcgccacggctactcctccggctgctcaggtccccaacgctccggggccatggaggtgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggcaactgacttaccttcccctcatgccgctcccatctctacccagtctcaggcctgcttacctcctcacagcccatgaagaccccttctcagccccaaaacctgaaggaggaatttcgccctactctggcccctttgttgtgggcccataacctgctaacaagccttcaggagaggagctgcctttccacccccttcaaggcaaggagggatggaggtcccttatttccttcagaatgatccccatcccccatagtcgccagactttctcatgttcccaggaagctcagaagtatggcagctaagaacacagctggctggaagaagacagggaccagactgaactgccaccctctgctagtcctcatgcaactcagtccccagaatggctccactgggagtggaggaagagctcagaggcccaggtgcagatagttctgcaatttagtctgtagcctcctcgttccctaccctaaaattctaaggggaagggacccatagaggcttgcctgtttccgctactatattatgcccagtgttcctcctcaccccacgtcctggggtcaggccagaccatgtttcgtcagccttggggactaggccagtgttgggcacctccaggaggaggcctgactggttcattaccctcccctactcagactgagcagcagtcccagataaccaagcaagctcagctctgtgggggcctccttcaaaagaccaacatcgcagacattaggaagctgtaggaagagagatcatgggtttgacctctgcccacatggccatggagtcagcctcagccctgtctgtactgctcgtccagctaaacgagcctggaataaacatgcagtttattc

SEQ ID NO: 120199 - DNA, 479 bp, Homo sapiens
  Payload ID: 3566
  Gene Symbol: CLPB
  Gene Name: ClpB homolog, mitochondrial AAA ATPase chaperonin
  ENST ID: ENST00000536297
  CDS Start-End: 1-134
cagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggagggcacagccactgaagggcaggactacttgtggatgtggcagcagttcttgggatgactgatgcttctggagcgagaacttgctgttctcagaagcagagacttagaaaacatccccaagcagaaagcttcttcctttgtccgttggaaaactctgtggcaagacatttgtagctaagaattggagtgttcaccaaggacattatctctgccgtgccttaaaatcaatcaatactccc

SEQ ID NO: 120200 - DNA, 624 bp, Homo sapiens
  Payload ID: 3566
  Gene Symbol: CLPB
  Gene Name: ClpB homolog, mitochondrial AAA ATPase chaperonin
  ENST ID: ENST00000544683
  CDS Start-End: 167-624
attgtgacatcagtttgcttgtcaaagtccacgtttctaaagtactgccactgtcttagtgggccctccacgcagtcctgagatgggtatgtcctggccgcggatctgaccagtgccccctttctcttcagatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcg

SEQ ID NO: 120201 - DNA, 2203 bp, Homo sapiens
  Payload ID: 3566
  Gene Symbol: CLPB
  Gene Name: ClpB homolog, mitochondrial AAA ATPase chaperonin
  ENST ID: ENST00000535990
  CDS Start-End: 1-2139
tgcttccggccggaatgtgactactgggagtctcggggagccgcagtggctgagggtagccaccggggggcgccctggaacatcgccggccttgttctccggacgtggggcagccaccggggggcgccagggaggacgcttcgataccaaatgcctcgcggctgccacttggggacgccttcctggtcccgaagaaacactcccaggacaggacagctggaacggggtccccagcagggccggactgggcatgtgcgccctggccgcagcgctggtggttcattgctacagcaagagtccgtccaacaaggatgcagccctgttggaagctgcccgtgccaacaatatgcaagaagtcagcagccccaagagactgcaaagaatgatgctcagtcaagaagctgggcagggctgaatgctggagtctcactgaagaacaccaagatttcctcctctgaatggcccctcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagaggaatgaaatgggacacacacccttggattatgcccgagaaggggaagtgatgaagcttctgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttcctcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtggcatggc

SEQ ID NO: 120202 - DNA, 1108 bp, Homo sapiens
  Payload ID: 3566
  Gene Symbol: CLPB
  Gene Name: ClpB homolog, mitochondrial AAA ATPase chaperonin
  ENST ID: ENST00000538021
  CDS Start-End: 1-228
ggctggtacgatgaagaacaccctctggtcttcctcttcttgggatcatctggaataggaaaaacagagctggccaagcagacagccaaatatatgcacaaagatgctaaaaagttggtacttgcttgtttccacacagggcttcatcaggctggacatgtccgagttccaggagcgacacgaggtggccaagtttattgggtctccaccaggctacgttggccatgaggagggtggccagctgaccaagaagttgaagcagtgccccaatgctgtggtgctctttgatgaagtagacaaggcccatccagatgtgctcaccatcatgctgcagctgtttgatgagggccggctgacagatggaaaagggaagaccattgattgcaaggacgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacatgaggtagaacgccgtgtggtgaaccagctggcagcagcctatgagcaggacctgctgccagggggctgtactttgcgcatcacggtggaggactcagacaagcagctactcaaaagcccagaactgccctcaccccaggctgagaagcgcctccccaagctgcgtctggagatcatcgacaaggacagcaagactcgcagactggacatccgggcaccactgcaccctgagaaggtgtgcaacaccatctagcagccacctgcctgctcctatgtgccctcaccatccaataaaggccccttggctgtg

SEQ ID NO: 120203 - DNA, 564 bp, Homo sapiens
  Payload ID: 3566
  Gene Symbol: CLPB
  Gene Name: ClpB homolog, mitochondrial AAA ATPase chaperonin
  ENST ID: ENST00000539148
  CDS Start-End: 118-564
actgtcttagtgggccctccacgcagtcctgagatgggtatgtcctggccgcggatctgaccagtgccccctttctcttcagatgcagccctgttggaagctgcccgtgccaacaatatgcaagaagtcagcaggctgttgtcagaaggtgcagatgtcaatgcaaagcacagacttggctggacagcactcatggtggcagccatcaaccgaaacaacagtgtggtacaggtcctgcttgctgctggggctgatccaaaccttggagatgatttcagcagtgtttacaagactgccaaggaacagggaatccattctttggaagatgggggacaggacggtgcaagccggcacatcacaaaccagtggacaagtgccctggagttcaggagatggctaggactccccgctggcgtcctgatcacccgagaggatgacttcaacaacaggctgaacaaccgcgccagtttcaagggctgcacggccttgcactatgctgttcttgctgatgactaccgcactgtcaaggagctgcttgatggaggagccaaccccctgcagagg

SEQ ID NO: 120204 - DNA, 2500 bp, Homo sapiens
  Payload ID: 3567
  Gene Symbol: CLPTM1L
  Gene Name: CLPTM1-like
  Uniprot ID: Q96KA5
  ENST ID: ENST00000320895
  CDS Start-End: 259-1875
acttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaa

SEQ ID NO: 120205 - DNA, 1740 bp, Homo sapiens
  Payload ID: 3567
  Gene Symbol: CLPTM1L
  Gene Name: CLPTM1-like
  ENST ID: ENST00000507807
  CDS Start-End: 15-1124
ctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagc

SEQ ID NO: 120206 - DNA, 1945 bp, Homo sapiens
  Payload ID: 3567
  Gene Symbol: CLPTM1L
  Gene Name: CLPTM1-like
  Uniprot ID: Q96KA5
  ENST ID: ENST00000620010
  CDS Start-End: 259-1875
acttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggag

SEQ ID NO: 120207 - DNA, 2032 bp, Homo sapiens
  Payload ID: 3567
  Gene Symbol: CLPTM1L
  Gene Name: CLPTM1-like
  ENST ID: ENST00000630539
  CDS Start-End: 446-1555
gcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctatttt

SEQ ID NO: 120208 - DNA, 1194 bp, Homo sapiens
  Payload ID: 3567
  Gene Symbol: CLPTM1L
  Gene Name: CLPTM1-like
  ENST ID: ENST00000627897
  CDS Start-End: 15-1124
ctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggag

SEQ ID NO: 120209 - DNA, 5224 bp, Homo sapiens
  Payload ID: 3568
  Gene Symbol: CLUH
  Gene Name: clustered mitochondria (cluA/CLU1) homolog
  Uniprot ID: O75153
  ENST ID: ENST00000435359
  CDS Start-End: 87-4016
cggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 120210 - DNA, 5244 bp, Homo sapiens
  Payload ID: 3568
  Gene Symbol: CLUH
  Gene Name: clustered mitochondria (cluA/CLU1) homolog
  Uniprot ID: O75153
  ENST ID: ENST00000570628
  CDS Start-End: 107-4036
acagtgcccgcccgacgggcagcgagcagcagggagtctccccgaggccccgccccgcgagggcgcccagcctccctgggccttgagtcagaagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 120211 - DNA, 3844 bp, Homo sapiens
  Payload ID: 3568
  Gene Symbol: CLUH
  Gene Name: clustered mitochondria (cluA/CLU1) homolog
  ENST ID: ENST00000574426
  CDS Start-End: 135-3844
gtcaaaggccacggcgcgcaccacgtgggccggtgactccgtccttccctcagcagccgcggcgcgcagggcacttgggttagtggcgcggcgggcggcgcggacagccgaggcggacgcccgctcccgccaccatggttatcaagacggacgagttgccggcggccgccccggccgacagcgcccgggaacacggctcgcaggccgggggcaaggggcggccgggcgcggccgagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagcagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttgaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcag

SEQ ID NO: 120212 - DNA, 583 bp, Homo sapiens
  Payload ID: 3568
  Gene Symbol: CLUH
  Gene Name: clustered mitochondria (cluA/CLU1) homolog
  ENST ID: ENST00000576885
  CDS Start-End: 90-583
aaaggccacggcgcgcaccacgtgggccggtgactccgtccttccctcagcagccgcggcgcgcagggcacttggagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacgg

SEQ ID NO: 120213 - DNA, 433 bp, Homo sapiens
  Payload ID: 3568
  Gene Symbol: CLUH
  Gene Name: clustered mitochondria (cluA/CLU1) homolog
  ENST ID: ENST00000576309
  CDS Start-End: 161-433
ggggtcgctccgacgtttgcgggacagcccccttcggcacctgctccgcggcggcctcccaggcatcccctgtgcgcagggctgcagccctgggagtgaagctccgctcgaggcttcccaggcttggtttgtgggaagagcacgagagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattcaccaggtgctcatggaccgggaggacacgtgtcaccgcacctgcttctcactg

SEQ ID NO: 120214 - DNA, 545 bp, Homo sapiens
  Payload ID: 3568
  Gene Symbol: CLUH
  Gene Name: clustered mitochondria (cluA/CLU1) homolog
  ENST ID: ENST00000571566
  CDS Start-End: 326-545
agagcttgacaaacgctccgaaggttataggcctcgggtgcttcccaaaggccccctgcggcctggccaggaaagacccaccggcgctctctgcctggagcacttcaactcactgcaagacctggtcccaatgtcccctctgcagcattctctgacctcaccgttccgtccccgccaagcccctgccaagtgaaaaatacgagttaaagcgtcctggctgtggatggagtcagacccggctctaccccttgctctctgtgtgaccttggtctcggcctcctccactgtaaaatgaggacaccagcctggagagctgccatcagtcatgctcttaaacggggactgcccagagagcctgaagaaggaggcggcggcggccgagccacccagggaaaatgggcttgacgaggccggcccgggagatgagaccaccggccaggaagtcattgtcattcaggacacgggcttttctgtgaagatcctcgcccctgggatcgagcccttctccctgcaggtgtccccccaggagatggtgcaggagattc

SEQ ID NO: 120215 - DNA, 480 bp, Homo sapiens
  Payload ID: 3568
  Gene Symbol: CLUH
  Gene Name: clustered mitochondria (cluA/CLU1) homolog
  ENST ID: ENST00000572129
  CDS Start-End: 1-480
ccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatgg

SEQ ID NO: 120216 - DNA, 4959 bp, Homo sapiens
  Payload ID: 3568
  Gene Symbol: CLUH
  Gene Name: clustered mitochondria (cluA/CLU1) homolog
  ENST ID: ENST00000575014
  CDS Start-End: 1-3754
ctccctgcaggtgtccccccaggagatggtgcaggagattcaccaggtgctcatggaccgggaggacacgtgtcaccgcacctgcttctcactgcacctggatggcaacgtgctggaccacttctcggagctgcgcagcgtcgaggggctgcaggagggctctgtgctgcgtgtggtggaagagccgtacacggtgcgtgaggcccgcatccacgtgcgccatgtccgagacctgctcaagagcctggacccatccgatgccttcaacggggttgactgcaactccttgtccttcctgagtgtcttcaccgacggcgacctgggagacagcgggaagcggaagaagggcttggagatggaccccatcgactgcacaccacccgagtacatcctgccagggagccgggagcggccactgtgtcccctgcagccccaaaaccgtgactggaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtccacagcttatcacttcaaccccaagcccgccagcccccgcttcctaagccattccctagtggagctgctcaaccagatcagcccgaccttcaagaagaacttcgctgtgctgcagaagaaaagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctggacagacccgagactggaatgaggagctgcagacgacgagggagctgcctcgcaagaacctgcctgagcggctgctccgagaaagggccatattcaaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacagcagaccctcggagccgggaggtgatccgcaacgcgtgcaaggcggtcggctccatcagcagcaccgccttcgacattcgcttcaatcctgacatcttctcaccaggggttcgtttccctgagtcctgccaggatgaagttcgggaccagaagcagctgctgaaggacgcggctgccttcctgctctcctgccagatccctggcttggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttaaaatcggcattggagaactcatcacccgctcggccaagcacatcttcaagacgtacttacagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtgtgagaccgtggaccaggctgtggagacctacggcctgcagaagataacgctcctgcgggagatctcgctgaaaacagggatccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggccctgagtaaccagcagaaggcggtgctgatgagcgagcgggtgatgggcaccgagcaccccaacaccatccaggaatacatgcacctggccctgtactgcttcgccagcagccagctgtccaccgccctgagcctgctgtaccgcgcccgctacctcatgctgctggtgttcggggaagaccaccccgagatggcgctgctggacaacaacatcgggctggtgctgcacggggtgatggagtacgacctgtcgctgcgcttcctggagaacgcgctggccgtcagcaccaagtaccacgggcccaaggccctcaaggtggccctcagccaccaccttgtcgcccgagtctacgagagcaaagctgagttccggtcggccctgcagcacgagaaggagggttacaccatctacaagacgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaagttcacggcccccagcatggccagcgtcttggagcagctgaacgtcattaacggcatcctcttcattcctctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgc

SEQ ID NO: 120217 - DNA, 3080 bp, Homo sapiens
  Payload ID: 3569
  Gene Symbol: CLU
  Gene Name: clusterin
  Uniprot ID: P10909
  ENST ID: ENST00000316403
  CDS Start-End: 407-1756
tgtgtcttggactgggacagacagccgggctaaccgcgtgagaggggctcccagatgggcacgcgagttcaggctcttccctactggaagcgccgagcggccgcacctcagggtctctcctggagccagcacagctattcgtggtgatgatgcgccccccggcgcccccagcccggtgctgcaccggcccccacctcccggcttccagaaagctccccttgctttccgcggcattctttgggcgtgagtcatgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtcacactgtttcaaaagtta

SEQ ID NO: 120218 - DNA, 2098 bp, Homo sapiens
  Payload ID: 3569
  Gene Symbol: CLU
  Gene Name: clusterin
  Uniprot ID: P10909
  ENST ID: ENST00000405140
  CDS Start-End: 316-1665
aacactggcagggcagcctgctgtcggcttagaggggatgggcagtgtggagggcctggcagagcaagaggactcatccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggtt

SEQ ID NO: 120219 - DNA, 303 bp, Homo sapiens
  Payload ID: 3569
  Gene Symbol: CLU
  Gene Name: clusterin
  ENST ID: ENST00000519472
  CDS Start-End: 57-303
cgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagagg

SEQ ID NO: 120220 - DNA, 520 bp, Homo sapiens
  Payload ID: 3569
  Gene Symbol: CLU
  Gene Name: clusterin
  ENST ID: ENST00000521770
  CDS Start-End: 1-422
gggcagactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagt

SEQ ID NO: 120221 - DNA, 426 bp, Homo sapiens
  Payload ID: 3569
  Gene Symbol: CLU
  Gene Name: clusterin
  ENST ID: ENST00000523396
  CDS Start-End: 180-426
ggcgtcgccaggaggagcgcgcgggcacagggtgccgctgaccgaatatttgaagatggtgaatgtgaagaatcttgtataaactgcatggaagacagaaggaaatataccacagtgctaacctttgcctctgggtgatatgaattaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagagg

SEQ ID NO: 120222 - DNA, 654 bp, Homo sapiens
  Payload ID: 3569
  Gene Symbol: CLU
  Gene Name: clusterin
  ENST ID: ENST00000522413
  CDS Start-End: 266-654
gccaggaggagcgcgcgggcacagggtgccgctgaccgatggggaaactgagacctggagacctgccgcgttgcgggagacccaggctagcaggtgacagagctggcctgcaccgagctccttcctgcagcatatcctctgcgaagatgcggatctctcagttgtggctttcggcttgcatgcatgagtcatctagttttcttctaaattctctagctctctggacactgttgcctaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcag

SEQ ID NO: 120223 - DNA, 791 bp, Homo sapiens
  Payload ID: 3569
  Gene Symbol: CLU
  Gene Name: clusterin
  ENST ID: ENST00000522238
  CDS Start-End: 696-791
ggctttcggcttgcatgcatgagtcatctagttttcttctaaattctctagctctctggacactgttgcctgtaagtatgaggctgcggatttcagtatatgctgcaaccaccgaaatccgactttttctgcctcctaatgcatctgaggtgcatcagagaaaagtcacacaagatccaccaggcctcagacctctgattccacagtctcattttacagatgataatctgaggcctggagaggtttaggactggtgccaacactaaacagcaaataagtatcagaattgggattcgagccaaagcctcttgaccttccagaatttctggacctagttaaaaaaaatatgatttttattattattttttaaacggagaggttaggaatttaaaggaaagtacagatactatataaaaaaagatgcccatgaaaatgttaagttataataatagtggagcattgggcacaactgaaatggccaatcttgtgagaatggtaaaataaacttaggtccgtgagtaagtggagtattacatagccataaaagtatgcccttaaagaatatttgaagatggtgaatgtgaagaatcttgtataaactgcatggaagacagaaggaaatataccacagtgctaacctttgcctctgggtgatatgaattaccgaggcgtgcaaagactccagaattggaggcatgatgaagactctgctgctgtttgtggggctgctgctgacctgggagagtgggcaggtcctgggggaccagacggtctcagacaatgagctccag

SEQ ID NO: 120224 - DNA, 737 bp, Homo sapiens
  Payload ID: 3569
  Gene Symbol: CLU
  Gene Name: clusterin
  ENST ID: ENST00000520796
  CDS Start-End: 126-737
gatggattcggtgtgaagggctggctgctgttgcctccggctcttgaaagtcaagttcaggtggtgctgagactccctgggggctgcagcgctgtgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctac

SEQ ID NO: 120225 - DNA, 2381 bp, Homo sapiens
  Payload ID: 3569
  Gene Symbol: CLU
  Gene Name: clusterin
  Uniprot ID: P10909
  ENST ID: ENST00000523500
  CDS Start-End: 787-2136
catccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcaggtggtgctgagactccctgggggctgcagcgctgtggtgaatggggagcgtctgctggggtgaaggtttaggtgcacattgcagaggacgtggctggtctctgggatgcagtccctctgtggaggtggcatggggagggacggatgcatgacctaaggggggtattttcagtgtctgacatgatcgataccactctggacaaggaggccaggatgcagaaagcctgtgtgcctcgctgattgtcggggaggatgtggcttggacaagagcctggttcctccgatgccagggttcttgtttcttccactcaacattgctgtcctgcagtccctccctccctgcacctcctgccttcgctttcattcgaggtgtccatggcaagtctggtcatttccccccatttcctcaggaataaaagtgcagcagtgcctgctgtggggacagctgagggcagtgaggccctggggagctgctgcaggcagcaggtgggcgggacgccagcaggctgtctagctgttcccatgatggtctcctgttctctgcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctga

SEQ ID NO: 120226 - DNA, 580 bp, Homo sapiens
  Payload ID: 3569
  Gene Symbol: CLU
  Gene Name: clusterin
  ENST ID: ENST00000520491
  CDS Start-End: 174-580
cactagggatgcagatggattcggtgtgaagggctggctgctgttgcctccggctcttgaaagtcaagttcaggtggtgctgagactccctgggggctgcagcgctgtggtgaatggggagcgtctgctggggtgaaggtttagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggt

SEQ ID NO: 120227 - DNA, 850 bp, Homo sapiens
  Payload ID: 3569
  Gene Symbol: CLU
  Gene Name: clusterin
  ENST ID: ENST00000522098
  CDS Start-End: 1-850
ccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgta

SEQ ID NO: 120228 - DNA, 583 bp, Homo sapiens
  Payload ID: 3569
  Gene Symbol: CLU
  Gene Name: clusterin
  ENST ID: ENST00000519742
  CDS Start-End: 167-583
ctttcaggggcccctggcagagaggtgtttctggctggctttgtctctctggcatgacaaaggctctgttcctgctggaggcatttcagggctcagtgggcagctggggcagagcccgtgagaccacagccttcctgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccag

SEQ ID NO: 120229 - DNA, 878 bp, Homo sapiens
  Payload ID: 3569
  Gene Symbol: CLU
  Gene Name: clusterin
  ENST ID: ENST00000523589
  CDS Start-End: 66-878
caggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgc

SEQ ID NO: 120230 - DNA, 1039 bp, Homo sapiens
  Payload ID: 3569
  Gene Symbol: CLU
  Gene Name: clusterin
  ENST ID: ENST00000560566
  CDS Start-End: 148-1039
tctttgcgcctgattacttctcatgagaggcactccttgttaatgtgctactgagtgtccagatgggcctgctgggctgagcgggctttggatgtgaaccatttcaggaaggggaaccccatcgtcctgttggttctgtgatggcaaatggaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccggg

SEQ ID NO: 120231 - DNA, 1643 bp, Homo sapiens
  Payload ID: 3570
  Gene Symbol: CLUAP1
  Gene Name: clusterin associated protein 1
  ENST ID: ENST00000341633
  CDS Start-End: 57-1355
tgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatatggaagcagcaccagctctcttaggtaaatgcaagacttccagctccaagaagcaggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaag

SEQ ID NO: 120232 - DNA, 723 bp, Homo sapiens
  Payload ID: 3570
  Gene Symbol: CLUAP1
  Gene Name: clusterin associated protein 1
  ENST ID: ENST00000572632
  CDS Start-End: 1-86
aaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaa

SEQ ID NO: 120233 - DNA, 588 bp, Homo sapiens
  Payload ID: 3570
  Gene Symbol: CLUAP1
  Gene Name: clusterin associated protein 1
  ENST ID: ENST00000574551
  CDS Start-End: 136-588
gtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagac

SEQ ID NO: 120234 - DNA, 692 bp, Homo sapiens
  Payload ID: 3570
  Gene Symbol: CLUAP1
  Gene Name: clusterin associated protein 1
  ENST ID: ENST00000574369
  CDS Start-End: 88-692
ggttgccatagagatcgtcgagcgctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatgattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaa

SEQ ID NO: 120235 - DNA, 739 bp, Homo sapiens
  Payload ID: 3570
  Gene Symbol: CLUAP1
  Gene Name: clusterin associated protein 1
  ENST ID: ENST00000575134
  CDS Start-End: 62-169
gggcctgtgatcgctgaggggcgagcagttgcgaccctgggctcctggggacctgagcgttatgtctttccgcgacctccgcaatatgagccccagactgacatcccgcctgacgtggatactgaacaggaccgagttttcttcattaaggcaattgcccagttcatgattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaat

SEQ ID NO: 120236 - DNA, 726 bp, Homo sapiens
  Payload ID: 3570
  Gene Symbol: CLUAP1
  Gene Name: clusterin associated protein 1
  ENST ID: ENST00000574592
  CDS Start-End: 87-212
gttgccatagagatcgtcgagcgctgggcctgtgatcgctgaggggcgagcagttgcgaccctgggctcctggggacctgagcgttatgtctttccgcgacctccgcaatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaaga

SEQ ID NO: 120237 - DNA, 5126 bp, Homo sapiens
  Payload ID: 3570
  Gene Symbol: CLUAP1
  Gene Name: clusterin associated protein 1
  ENST ID: ENST00000571025
  CDS Start-End: 51-1214
cgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataact

SEQ ID NO: 120238 - DNA, 4163 bp, Homo sapiens
  Payload ID: 3570
  Gene Symbol: CLUAP1
  Gene Name: clusterin associated protein 1
  Uniprot ID: Q96AJ1
  ENST ID: ENST00000576634
  CDS Start-End: 145-1386
cgcgtcttcgcttcgctttttgtttgtccctgaccgtgcgccgtccaagggtccattggttgccatagagatcgtcgagcgctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtaggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctcaaaaaaaaaaaaaaaaaaaaaagcatacagtaaataaaaaagcacaaaacagttttcacttattttacaattaaaaagtcagaagacttctgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaa

SEQ ID NO: 120239 - DNA, 2221 bp, Homo sapiens
  Payload ID: 3570
  Gene Symbol: CLUAP1
  Gene Name: clusterin associated protein 1
  Uniprot ID: Q96AJ1
  ENST ID: ENST00000572600
  CDS Start-End: 80-823
cttggctcgctgcgcctctgcctcccaggttcaagagattcttctgcctcagcctcctaagtagctgggattacaggaaatgagaacagaagccattgccagacctctggaaataaacgagactgaaaaagtgatgagaattgcaataaaagagattttgacacaggttcagaagactaaagacctgctcaataatgtggcctctgatgaagctaatttagaagccaaaatcgaaaagagaaaattagaactggaaagaaatcggaagcgactagagactctgcagagtgtcaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggaagctaaaaacactctctgcctgatacagaacaagctcaaggaggaagagaagcgcctgctcaagagtggaagtaacgatgactcggacatagacatccaggaggacgatgaatccgacagtgagttggaagaaaggcggctgcccaagccacagacagccatggagatgctcatgcaaggaagacctggcaaacgcattgtgggcacgatgcaaggtggagactccgatgacaatgaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtcttt

SEQ ID NO: 120240 - DNA, 546 bp, Homo sapiens
  Payload ID: 3570
  Gene Symbol: CLUAP1
  Gene Name: clusterin associated protein 1
  ENST ID: ENST00000573370
  CDS Start-End: 93-245
ccattggttgccatagagatcgtcgagcgctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaaaggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaagattgcagatttgaaggcagccaggcagcttgcgtctgaaatcacctccaaaggagcatctctgtatgacttgctcggcatggaagtagagttgagggaaatgagaacagaagccattgccagacctctggaaataaacga

SEQ ID NO: 120241 - DNA, 414 bp, Homo sapiens
  Payload ID: 3570
  Gene Symbol: CLUAP1
  Gene Name: clusterin associated protein 1
  ENST ID: ENST00000576117
  CDS Start-End: 53-414
cagacatcctgaactccatctgcatcctttctgcagggctgatttcacagagatgatgagagccctgggataccctcgacatatttctatggaaaatttccgtacacccaattttggacttgtatctgaagtgcttctctggcttgtgaaaagatatgagccccagactgacatcccgcctgacgtggatactgaacaggaccgagttttcttcattaaggcaattgcccagttcatggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctc

SEQ ID NO: 120242 - DNA, 1897 bp, Homo sapiens
  Payload ID: 3571
  Gene Symbol: CLUL1
  Gene Name: clusterin-like 1 (retinal)
  Uniprot ID: Q15846
  ENST ID: ENST00000338387
  CDS Start-End: 100-1500
tccctgacacggatgaaaattaaagcagagaaaaacgaaggtccttccagaagctggtggcaacttcactggggagatattgcaaataacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttggaaaaaaa

SEQ ID NO: 120243 - DNA, 1943 bp, Homo sapiens
  Payload ID: 3571
  Gene Symbol: CLUL1
  Gene Name: clusterin-like 1 (retinal)
  Uniprot ID: Q15846
  ENST ID: ENST00000400606
  CDS Start-End: 146-1546
acctgcaggcccgggccgcggggttggtttccaccctggaggttgctgacaccctgtgccctcggctgacttccagccggtggcacagacgcctccagggggcagcactcaagcgcatcttaggaatgacagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttggaaaaaaa

SEQ ID NO: 120244 - DNA, 2199 bp, Homo sapiens
  Payload ID: 3571
  Gene Symbol: CLUL1
  Gene Name: clusterin-like 1 (retinal)
  ENST ID: ENST00000540035
  CDS Start-End: 210-1766
ggtttccaccctggaggttgctgacaccctgtgccctcggctgacttccagccggtggcacagacgcctccagggggcagcactcaagcgcatcttaggaatgacagagttgcgtccctctcggttgccaggctggagttcagtggcatgttcatagctcactgaagcctcaaattcctgggttcaagtgaccctcctacctcagccccatgaggacctgggactacagatggagtcttgctctcgttgcccagactggagtgcactgctgcaatctcagctcactgcaacctctacctcccaggttcaagcgattctcctgcctcagcctctcgagtggctgggactatagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttggaaaaaaatctaagattcattgctttgttttgtaaagaccaata

SEQ ID NO: 120245 - DNA, 2449 bp, Homo sapiens
  Payload ID: 3571
  Gene Symbol: CLUL1
  Gene Name: clusterin-like 1 (retinal)
  ENST ID: ENST00000581619
  CDS Start-End: 848-2323
ctccagcctggacaacacagtgagattctgtctcaaaataaataaataaataaacccaagcagaaaaagaatcactctgaaaacgatcacatctaactatcaatgctcatacagtttatggaattatcagcccaacttgataaaatcagtatttgaggaaactgtggataagccccctgatttcaatccccattgtgccaggtcctggttaactgaggttaacgaagtaaagagctgcagacactattaactgctaccttaaaccgattactctagcttagcctactttccacgtacagattttaccagtggacaacatgatgctttatcttgtttttctctccctgggacttttctccagacattgaaaacagaaatactaataaggccacttttacctgcctgatgcaagaacagaattttcaaactcaacattaatgcaactcctcagtccctgacaatggcgggtggaaaagtttctaaaaatatgcagcagcacaattatcgggaagagatgagatactgttacctaataaaaatgccataaatagagaatgatgaactaccatgggaaatgaatgcatagaagaggacatgctggaatgtgggacagtaaaaatcacttaaactttgcgtgaccttgaagaaagtcacgatgatctgtttttccaggtccctcaaacagtgagatgtggctgtttcccaagtcttcctctccagtgtaaagggtctgaatttagacgctttgtgagtcttccttctttcgacagcctggagtctctcttgagtctcaaggctgcctgagttcctctctaacatcctctaggcagtatcagctaatgagacaatgaattccatggaggcagcagtgggaacagaagtacctctcttggataatttacaacactgtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagcagagtgcctggttaggaatgccttgttgacaggaatagttaattctcaaaagggaaaaacaaaacttgtttccaaatacctggaaaacatgtttaacctcattaataaagacatgaaaacaaac

SEQ ID NO: 120246 - DNA, 1742 bp, Homo sapiens
  Payload ID: 3571
  Gene Symbol: CLUL1
  Gene Name: clusterin-like 1 (retinal)
  Uniprot ID: Q15846
  ENST ID: ENST00000579494
  CDS Start-End: 61-1461
ccagaagctggtggcaacttcactggggagatattgcaaagttagtgtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacc

SEQ ID NO: 120247 - DNA, 574 bp, Homo sapiens
  Payload ID: 3571
  Gene Symbol: CLUL1
  Gene Name: clusterin-like 1 (retinal)
  ENST ID: ENST00000579912
  CDS Start-End: 328-574
accctgcgtcacctgcaggcccgggccgcggggttggtttccaccctggaggttgctgacaccctgtgccctcggctgacttccagccggtggcacagacgcctccagggggcagcactcaagcgcatcttaggaatgacaggcagtatcagctaatgagacaatgaattccatggaggcagcagtgggaacagaagtacctctcttggataatttacaacactgagttgcgtccctctcggttgccaggctggagttcagtggcatgttcatagctcactgaagcctcaaattcctgggttcaagtgaccctcctacctcagccccatgaggacctgggactacagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacacca

SEQ ID NO: 120248 - DNA, 348 bp, Homo sapiens
  Payload ID: 3571
  Gene Symbol: CLUL1
  Gene Name: clusterin-like 1 (retinal)
  ENST ID: ENST00000585155
  CDS Start-End: 1-103
gcaatttggctgggtgtctgaactggcaaaccaggccccagaaacagagatcatctttaattcaatacaggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatacta

SEQ ID NO: 120249 - DNA, 1947 bp, Homo sapiens
  Payload ID: 3571
  Gene Symbol: CLUL1
  Gene Name: clusterin-like 1 (retinal)
  ENST ID: ENST00000620089
  CDS Start-End: 1-1557
atgaggacctgggactacagatggagtcttgctctcgttgcccagactggagtgcactgctgcaatctcagctcactgcaacctctacctcccaggttcaagcgattctcctgcctcagcctctcgagtggctgggactatagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaggtgtctatgttctatcacatctacaaacatgtcacttcctaattaacaaaatgttcttcctttagtttgcttttgcacttaaaatatatataattgacttttttgg

SEQ ID NO: 120250 - DNA, 2825 bp, Homo sapiens
  Payload ID: 3572
  Gene Symbol: CMIP
  Gene Name: c-Maf inducing protein
  Uniprot ID: Q8IY22
  ENST ID: ENST00000398040
  CDS Start-End: 224-2086
gtgtacgcgcgcgagccccagaggctgcggcagcagcagagcagcagagcagcagcccctgcctggcgcgacgtgcttccagtgcattctgagtcactcctctcctggcaaggggcacattcctgctgacgacttgtctcccgtggaggagcaacaggctctgctttccctggcctgagaaccctggcatatgtgcttgcctctgctgacagttgccagagcgatggcaagtgttgcccagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaa

SEQ ID NO: 120251 - DNA, 3937 bp, Homo sapiens
  Payload ID: 3572
  Gene Symbol: CMIP
  Gene Name: c-Maf inducing protein
  Uniprot ID: Q8IY22
  ENST ID: ENST00000539778
  CDS Start-End: 129-2168
ggcttcttggatgggctgggcgtgcatggcataaccgtttgagaacaacaaaccaagccggccgggctgccgctctgtttcctgcgaggagggaagttacagatctccgccctggcgtccggggaaggatgggacaggctgctgagccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagc

SEQ ID NO: 120252 - DNA, 4357 bp, Homo sapiens
  Payload ID: 3572
  Gene Symbol: CMIP
  Gene Name: c-Maf inducing protein
  Uniprot ID: Q8IY22
  ENST ID: ENST00000537098
  CDS Start-End: 73-2394
gggggccccgccgccccagcagcccaggacagccccctctccccgcccccagccccctcccccggcgcggccatggatgtgaccagcagctcgggcggcggcggcgacccccggcagatcgaggagaccaagccgctgctggggggcgacgtgtcggcccccgaaggcacgaagatgggcgccgtgccctgccgccgggctcttctgctttgcaacgggatgaggtacaaactgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaa

SEQ ID NO: 120253 - DNA, 2288 bp, Homo sapiens
  Payload ID: 3572
  Gene Symbol: CMIP
  Gene Name: c-Maf inducing protein
  ENST ID: ENST00000566513
  CDS Start-End: 370-2130
gtggtgctgaggagccgagcgggcggggagcctctagctgctccagcatcccacttgctcactgccccctgatcccgtggacagcgcagtcagaggcaggagcaggagaggaggaagcagaggaaaaggaggaggaggaggcggcttgcaactcctcagatccagagccggactccgagctaatgagggagcagcagacacggcctcccaacccttcccccaaggggaacccaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagg

SEQ ID NO: 120254 - DNA, 3512 bp, Homo sapiens
  Payload ID: 3572
  Gene Symbol: CMIP
  Gene Name: c-Maf inducing protein
  ENST ID: ENST00000566462
  CDS Start-End: 322-699
aatgaaggagttcatccagttagaaagtctctcaagcaggccgggtgcatggggcaggcagctgcaaaggcgggagcccgggcgggggtggagggagtgcttggcccagacctccgccttccgagggcctccgtttccatgatgtcagagaggcggaactaactctgcctcaaatccagggaggcagcagcccctgtcccaaccgctctctggcttcgacacagcgcccaagcaaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggtgagtcaccctgccccaacacccagaccccagcgcccagaacatgaggccccgcgcgcctccctggccttttgcgttggcacagatttggggaatgtggttggcccagcgtgacagccaggaactggggttgagattctggttaaggacttttgggggttttgtacagcttgtcctccattacggcaacaggaagaatctttttgcagttcctaagaattacaaaaataccgcagctggaggagaagaggaaagcctcccgggaagaataggcccaaataatgtctgtagatgccctgccctcaaggacccagagcgcgactttgcactcctttagtgtgtgctgcgcacagcgaggtccttccagagagcactgtatggaagggggcaggagtagccttgcagtggagaaaccagacacactcagcctcagccaggtgatcaaggtcaacatcgacaacaacaagccagttagacagaatattcccttcataggacgtataaaaacgacacttgacctctatggtcttcctcccagtaacccatcaccccattccaatcatgagaaaaacatcagacaaatcccaacaaggggacagtctacaaagtacctggccagtactccccacggtcaaggtcatcaaaaacaaggagattctaagaaactgtcacagctcagaggagtctacgggggcgtaacgactaaatgtcatttggggctctccatgggatcccagaacagaaaagggacatgaagggaaaactgaggaaatctgaataaagcttggcctttaatttttttttttaaatacaaaagcaggatttaattgcacacttagagcgggtggggcgcttgtaatctgtgtggccccttggtgttccctcatcattccagggacagcagcaaatgccattatttgccctgtatgtcacgaggaaactgaggcttagctaggtccactaagtggccacagggaccacaggtaggaataagaataacatctttttgcagatgcttattgaacactttcttggagtcaagagtgtggtgctctttgagtgtattgtgttattaaccctcatgccattcccatgacacctgtgcataggaggaatctgggacccagagaggtgggacgggataggcagggtctgatgagcagctgtgggtggtcctggtgggagctaaggagcaggcagcctgaggccagggcccattcccaatcacatgttgtactgagccagccaccacgttagattttagagtctcctggagcacgtgaaaacaactgaaaaagggtaaccacacatcatttcacttgtgatgtagcttgcctgtctccacaccatgcccctgaagaatagtatatcacctacagccccttccccagtcaggaatggaagtgcatgacacatgtgctcctctaccccttccatgctcatggcagacatcattaatcaattatagcactctttctgtagagccagagacagcatcacactctttcccctcctgcattccaggccaccactaccaactgaaatcgtgttagtaccataatgaatgctatgtaccattctctaccctaagcgattgcaaactgtaaatgaattgttgctgatttctgagcccctcctagatttggggtaaattcatttcttgttttcagaacacaggggatagggacaccctgtgcagttctttctccaggacaaggagactccccactgggggatggggcggggtttctgccttaatttgggcgctcatagtttcaaggaggagctctttctggctttggccagctagaaggaaaggtgccctgtttgttaactttaaaatcactacgggtgtagtgtatggagtgggctgtgccatgctggagttcagagcaaaggttcttcaggttttcttgcgaaggaccttaacttgtcaatggcagagccacacccccgggacatacttggcagaggaatgcctcttcaggcacataaacatttttgcatactccatgttagtcaataaaccgtttcataagggttctttgaggacatctgacttcaaagggaaaaaattcataattcagacaggctctcggggcttcaccatacaacgcctttcttgtatttggttagttttatgggcctggagtgttgaccatgtattaattttctctataaaaatcagaaccgctctgggcagacccagaatttatagtatctgtggcagtctggcagagagtagggaccctcagccatgagtcctcgcctcacttgtaacgagtaccccctaagtgatcccaggtgtctggggatgctttaacgcacccagatcccaccttgctcttggcgcctcctaattacacaccatgagcggcggcggcagaggagaactgctgggaggaccgaggaggatccgcctctcgtgtagaagaacagactgtattaaacagtgattatggccatgccaggcacaggaagacctgacctcatggaatcctaacaacacaggcggtgggcgagagagagctttgacatttactcactgaatgcgccctgatgcttaatgagtggcacgggtcagcagcaccgttgtggagctggggctctcagctggtgtggggggggggtcatgtctctggctaaggagcgtacctagcctgcctaagccatgagcctgttggggtggcatgaacagtgactgctcttcaccccaaatgcagtgtttctccttaaggaggcactcagacatttaggaaacggggggaacgtagccacggtgctgttctgggatttgggggctcccccattctgggtgcatctcttgcaaatatgttatgtgctccctttcacggatgagcaaactgaagctttgagagtctcaaagaatgttctttactagactgaaataaaaactagaaacaaaa

SEQ ID NO: 120255 - DNA, 4000 bp, Homo sapiens
  Payload ID: 3572
  Gene Symbol: CMIP
  Gene Name: c-Maf inducing protein
  ENST ID: ENST00000621537
  CDS Start-End: 1-2037
gggcagtgtgagcagccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaa

SEQ ID NO: 120256 - DNA, 1201 bp, Homo sapiens
  Payload ID: 3573
  Gene Symbol: CMSS1
  Gene Name: cms1 ribosomal small subunit homolog (yeast)
  Uniprot ID: Q9BQ75
  ENST ID: ENST00000421999
  CDS Start-End: 147-986
gacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatga

SEQ ID NO: 120257 - DNA, 753 bp, Homo sapiens
  Payload ID: 3573
  Gene Symbol: CMSS1
  Gene Name: cms1 ribosomal small subunit homolog (yeast)
  ENST ID: ENST00000478909
  CDS Start-End: 79-753
agatactgtggtgctgagacggttatcagactagtagcaaagacattcattttgtagtcattatagcaaaggcatttgatgcagctggtttataaaaaccctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgc

SEQ ID NO: 120258 - DNA, 881 bp, Homo sapiens
  Payload ID: 3573
  Gene Symbol: CMSS1
  Gene Name: cms1 ribosomal small subunit homolog (yeast)
  ENST ID: ENST00000491299
  CDS Start-End: 98-214
gtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagggcccctcccagtgtcttcaagagtttgtgcaagcaaatacctgaaaacctaaggaaaatgatgggaaactgaacttcagatacttatcaaaaagaagatgaaggtagggattgagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaagg

SEQ ID NO: 120259 - DNA, 538 bp, Homo sapiens
  Payload ID: 3573
  Gene Symbol: CMSS1
  Gene Name: cms1 ribosomal small subunit homolog (yeast)
  ENST ID: ENST00000497345
  CDS Start-End: 1-247
tgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgt

SEQ ID NO: 120260 - DNA, 397 bp, Homo sapiens
  Payload ID: 3573
  Gene Symbol: CMSS1
  Gene Name: cms1 ribosomal small subunit homolog (yeast)
  ENST ID: ENST00000463526
  CDS Start-End: 321-397
gtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccaggtttttaaaactcatttggacacccacctcaatatatgctgtgcaattagaataatccagaagactgaaagagtaaagcatcagatggtgaaggagaaggagacacagaagtgatgcagcaggagacagttccagttcctgtaccttcagagaaaaccaaacagcctaaagaatgttttttgatacaacc

SEQ ID NO: 120261 - DNA, 1056 bp, Homo sapiens
  Payload ID: 3573
  Gene Symbol: CMSS1
  Gene Name: cms1 ribosomal small subunit homolog (yeast)
  Uniprot ID: Q9BQ75
  ENST ID: ENST00000489081
  CDS Start-End: 60-845
tttagtgtcacaggagacacgagggcaaagtgctgaggaaactctagagcaacatcggaatgcatggtgaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgt

SEQ ID NO: 120262 - DNA, 902 bp, Homo sapiens
  Payload ID: 3574
  Gene Symbol: CDRT1
  Gene Name: CMT1A duplicated region transcript 1
  ENST ID: ENST00000261644
  CDS Start-End: 1-902
gtccaaagccccagaaaatgaacacttccttggggcagcatctaaccctgaggaaccatggaggaattcactccggtgtatatccgaaatgaataggctgttttctggaaaagcagacataaccaagccagggtacgatccctgcaatctattggttgacctggatgacatcagagacctgtcttctgggttcagcaaataccgagacttcatccgttacctgcccatccacctctccaagtacattctaagtatgctggggtgtatgaggggatttcccagacacctcccctcttggcccagttctggggtttctgggtccatcttttttttttttccaggaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagaggaattgatcctaattatgccaataaggtttctatcccagttcctaaaatggtagatgacgggaagagcatgcgtgtgaaacatccgaagtggaagttgagaacgaagaatgagtacaacctgtggactgcataccagaacgaggaaacgcagcaggtcctgatggaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatca

SEQ ID NO: 120263 - DNA, 1557 bp, Homo sapiens
  Payload ID: 3574
  Gene Symbol: CDRT1
  Gene Name: CMT1A duplicated region transcript 1
  Uniprot ID: O95170
  ENST ID: ENST00000354433
  CDS Start-End: 212-970
ggattcaaatccaggcccctgactctaagctgaaccatgagaatctgctgcctcccaactaactaattatctacatgggttctacgcagtatgatcctttgggccctcaggaactctcacattcttttggcctgattcctgcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtggagtgatcatctccaactcaactcaatcacactgcctaaaatcggcactgacaaagtacaaataatccacctatccagtagaggcagcactgatctggctgattcctggatatggggaatcctctttatgaaacaaacttacaataagaaagaatatgtttgtgggagctctggctgctcttcttgattttgctagctaagagtaaagtggttaagagagtcaggattagagtgttctggattcatataggttctgtcccttcctggctatagggcagctaggtttcacttactcctctctataagagaaatgatcatcttttcctcctagggttgaagactgactgagacaatgcctcctgcacagtgttccattttatatttagtcatgaacaaacaacttcagacacaatattggaagatttgggcagaaaatactacc

SEQ ID NO: 120264 - DNA, 2337 bp, Homo sapiens
  Payload ID: 3574
  Gene Symbol: CDRT1
  Gene Name: CMT1A duplicated region transcript 1
  ENST ID: ENST00000395667
  CDS Start-End: 193-2337
agacttctgctggcagttactgagagagataggctttccatccatggcagccatttacttttgctctgggagacgtttgtaatagaaaaggcacaactggggtatttattcatttccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccatccctctatgccggaagtgtgagacgcgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcgacctcagcaagaaagaggggaaagttgtgaagtcctccttgaaccaaatgttggataaaacagtagaacagaagatgaaagagatcttgtattggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttccttggggcagcatctaaccctgaggaaccatggaggaattcactccggtgtatatccgaaatgaataggctgttttctggaaaagcagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagaggaattgatcctaattatgccaataaggtttctatcccagttcctaaaatggtagatgacgggaagagcatgcgtgtgaaacatccgaagtggaagttgagaacgaagaatgagtacaacctgtggactgcataccagaacgaggaaacgcagcaggtcctgatggaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagtgatcacttacggaagacctatctgccagttgagtggaagacagatggaaggagggttaggaagaaggcagagaagtcagctgggatgtgctgtaataacccacgcaaaaccgatgatgggctgaagctaaagcactga

SEQ ID NO: 120265 - DNA, 2571 bp, Homo sapiens
  Payload ID: 3574
  Gene Symbol: CDRT1
  Gene Name: CMT1A duplicated region transcript 1
  Uniprot ID: O95170
  ENST ID: ENST00000395906
  CDS Start-End: 1-2259
atggaaaacctggaatcaaggctcaagaatgccccctattttcgttgtgagaagggaaccgattccatccctctatgccggaagtgtgagacgcgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcgacctcagcaagaaagaggggaaagttgtgaagtcctccttgaaccaaatgttggataaaacagtagaacagaagatgaaagagatcttgtattggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttccttggggcagcatctaaccctgaggaaccatggaggaattcactccggtgtatatccgaaatgaataggctgttttctggaaaagcagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagaggaattgatcctaattatgccaataaggtttctatcccagttcctaaaatggtagatgacgggaagagcatgcgtgtgaaacatccgaagtggaagttgagaacgaagaatgagtacaacctgtggactgcataccagaacgaggaaacgcagcaggtcctgatggaggagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccacgagggagctgtgaaatgcctgttctttgaccagtggcatctcctctcaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatggcaactcctggaacagcacaacaagtggcaaaggacacagctagcaacgggctggaaaaaggcagagaacgtggagtgatcatctccaactcaactcaatcacactgcctaaaatcggcactgacaaagtacaaataatccacctatccagtagaggcagcactgatctggctgattcctggatatggggaatcctctttatgaaacaaacttacaataagaaagaatatgtttgtggga

SEQ ID NO: 120266 - DNA, 562 bp, Homo sapiens
  Payload ID: 3574
  Gene Symbol: CDRT1
  Gene Name: CMT1A duplicated region transcript 1
  ENST ID: ENST00000583965
  CDS Start-End: 33-269
tcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatgg

SEQ ID NO: 120267 - DNA, 800 bp, Homo sapiens
  Payload ID: 3574
  Gene Symbol: CDRT1
  Gene Name: CMT1A duplicated region transcript 1
  ENST ID: ENST00000571263
  CDS Start-End: 33-296
tcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcttcaatgggaactgtatgaaggtgataaaagccaatggcagaggcgatcctgtgctgtccttctttattcagggcaacagaatttcagtctgccacatcagcacatttgctaaaagaattaacgtgggatggaatggaatcgaaccaagtgctacagctcagggaggaaatgcctccttgaccgagtgtgctcatgtgagactccacatcgcaggacacttaccagcatcgaggctgcccgtggccgctgtccagcccatgacaggcgggatggccccaaccacagctccgacccatgtgttggcaatgctgatccttttcagtggtgtgtagcagcaggtatacaggaaaatgttgaagagccccagggctcctgtgagtggattcacccccaaggtcagaatgg

SEQ ID NO: 120268 - DNA, 1082 bp, Homo sapiens
  Payload ID: 3574
  Gene Symbol: CDRT1
  Gene Name: CMT1A duplicated region transcript 1
  ENST ID: ENST00000472534
  CDS Start-End: 1-211
gaactgtatgaaggtgataaaagccaatggcagaggcgatcctgtgctgtccttctttattcagggcaacagtgatcacttacggaagacctatctgccagttgagtggaagacagatggaaggagggttaggaagaaggcagagaagtcagctgggatgtgctgtaataacccacgcaaaaccgatgatgggctgaagctaaagcactgagatgatgcggagaaagcacaaaaacaaggacaattggaaactcctggaaaactgcccagtcacccaaagaaaaagtcttggaaaatccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagccaagcg

SEQ ID NO: 120269 - DNA, 794 bp, Homo sapiens
  Payload ID: 3574
  Gene Symbol: CDRT1
  Gene Name: CMT1A duplicated region transcript 1
  ENST ID: ENST00000630868
  CDS Start-End: 13-744
tggaaaatccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagccaagcgg

SEQ ID NO: 120270 - DNA, 655 bp, Homo sapiens
  Payload ID: 3575
  Gene Symbol: CDRT15
  Gene Name: CMT1A duplicated region transcript 15
  ENST ID: ENST00000431716
  CDS Start-End: 104-472
acttggtgggagtcgctcaagagagcaagatgttctcgtgttgcttccccacttcgagaggttgctgcttcaggaatggagggagtgagagccttttccgacgatgccgaagaaggctcatccctcaccccagacgcctgtcgcccgttgtaataaggcgcatccagctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttca

SEQ ID NO: 120271 - DNA, 766 bp, Homo sapiens
  Payload ID: 3575
  Gene Symbol: CDRT15
  Gene Name: CMT1A duplicated region transcript 15
  Uniprot ID: Q96T59
  ENST ID: ENST00000420162
  CDS Start-End: 17-583
cgctcaagagagcaagatgttctcgtgttgcttccccacttcgagaggttgctgcttcaggaatggagggagtgagagccttttccgacgatgccgaagaaggctcatccctcaccccagacgcctgtcgcccgttgtaataaggcgcatccaggtaccacaggacagcctggggcaggccctagcaggccaggccacaccagagatcccattggggctgcagctgcacactgtccttgtccaggagattcaggagctcattgaggcacagacacttgctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttca

SEQ ID NO: 120272 - DNA, 1048 bp, Homo sapiens
  Payload ID: 3576
  Gene Symbol: CDRT15L2
  Gene Name: CMT1A duplicated region transcript 15-like 2
  Uniprot ID: A8MXV6
  ENST ID: ENST00000399044
  CDS Start-End: 21-866
gagacgctcaagagagcaagatgttctcctgttgcttccccacttcgagaggttgctgcttcaggaatggagggagtgagagccttttccgacaatgccgaagaaggctcatccctcaccccagacgcctgtggccctttgtaagaaggcgcacccaggtaccacaggacagcccggggcaggccctagctggccaggccacaccagagatcccatcggggctgcctctgcacattgtccttgtccaggaggagattcgggagcccatggaggcacagacacatgctcctggtccgtacgcagacatagcagcacttgcggcaccggctgtcgagccaaagccagcatgggaagagccccctccagagagagcgctggaggtggagggagctccagccaaggaccagcccagccaggagctgcctgaaatcatggcacctactgtagccactggccttaatgctggagctgaaaacgtggctggagagagaagtgggagggagggggtgacaagcacagccccagccagcagatcccatgctgcccctagtcctgggcatggtggcaaacatggaggcggagaccagggcattcagactggactcctgtacctcgctggagagaggcttctctcattcgccggaaccacagccctgctgctgcagggcctgtttattgtgctaattctggtggggtatatctctgtgaaggtgatgctcaagagcattaaaacaaggctgggaagaagagttccagcagctcctcctgctctcagacgcaatcttctcctccaggcatggaagtgtgtctgcaactgggcatccaggctgtttgcccctaatgtgctgccccgaacgggctcttaacaggtgggcaggggttgaggggaccaggaggtggctccaaagggtacagcaaggaaagcttttaaagacagctgttgtgctccaggctctccatgccaccacctgccctagcatttattaatagtgttagaattacaagtttatgaaatgaaatataaataaagtttgatttctgaaacttc

SEQ ID NO: 120273 - DNA, 632 bp, Homo sapiens
  Payload ID: 3577
  Gene Symbol: CDRT4
  Gene Name: CMT1A duplicated region transcript 4
  ENST ID: ENST00000524205
  CDS Start-End: 559-632
gacattctaatgtcaccaatttttcgacatgctaatgccagcaattttttttgaaagttgaaatagaacataataaggcaacaaaacgagactaagagggttctgcaccgtgttccaacaatcttcagtccccttcactgttcatgtctaagcactgaggcgttctaaagcaggtcaccttttgcctcaaggacttttcttgaaatatcatggtcttgctctgtcgcccaggctggagtgcagtggcgtggtcacagctcattgcagcttcgacttcctgggctgaagcgatcctcccatctcggcctgtcaagtagctggaaccacaggcgcgccactacacctggctaatttatttttattttattttttgtagagacggtctcgccacattgcccagactggtctgaaagtcttgggctcaagagatcctcccgcttccgccttccaaagcgctgggataacaggcgtgagccgctgcccgggccatccctcgaggaagtttcatcaggaatctgaacctgtgatgttaagaaatcagtaaatattaaaaagaagatggatgcaagaaggatgaagaaagaagaaggactcacagaaaacactggacttccccggaagctacttgaaaa

SEQ ID NO: 120274 - DNA, 2498 bp, Homo sapiens
  Payload ID: 3577
  Gene Symbol: CDRT4
  Gene Name: CMT1A duplicated region transcript 4
  ENST ID: ENST00000619038
  CDS Start-End: 282-740
aggggcaagaggatggttagctgcagcaaagagagagccaaagagaagtgggattgagagcacaggggacagctggagacaaaatataaacgccgggcaggggaacagccaagatagtgcaggaaggatggggaatcacagaaacttctcaggaacccagtgaaatgagctgcaccaggaactttaagagagagttttcagctgggagaagaggaaggcaagatatcagaacaagaatctgaacctgtgatgttaagaaatcagtaaatattaaaaagaagatggatgcaagaaggatgaagaaagaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataattttttta

SEQ ID NO: 120275 - DNA, 5130 bp, Homo sapiens
  Payload ID: 3578
  Gene Symbol: CNDP2
  Gene Name: CNDP dipeptidase 2 (metallopeptidase M20 family)
  Uniprot ID: Q96KP4
  ENST ID: ENST00000324262
  CDS Start-End: 317-1744
gaaatggggcggggagagagtgacaccacccctctgcctgtggctggattggtgggcgtggcgggggcgtggcgatgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaatcgctccatctcagttgctcgtcgcgtgcacaccatgcttattgagtggtgtctggttggtggtgtcagctcagggcaggggacagcaggcaggacccggaaaacagaacccaggtcttcccaggcgagcactccctccctcgtccacacaagtggaggctcactcgtggccccctgcatgttccgagaagtgtccctgtctctgctccttaacggctgtggggccacaggaagtccagctggcttaaacaaagaattgattggcccacttgacataaaagaacagagtaaactcaatgaaaggaaaaggctccttgaagtggttggttccagggctgggcagggaagatgcaagatgagtctggaccctctcacatcggaacgtaaggatgcgctcctgagggcgtggggctgcgtccaaggacacaggagccagcctggaagagtttgcaggggcccaggggagcaattggagtgagaaaatagcagtagtgttggatttttaccatggaataaacaacaatccatgagtccatactaatataaataaagtgacaaagtgggtgagaaggaccagtgcccctggatgaagaatctctgctcatgtgggaggaaggtgggagatcaaagctggagcacttgctgctgcaggtgagacccctgacacactctcaaattggtaggcaaaggtttaaagaacgggatatttgcttagcttaaaagcacctcccaaggggaaaacagtaacttcacagtggagagacctggcaggcaccaccctcagatcaaaatgaacctcagcagtaatgacacgtccacatcagcacccccaacaccactccctgaggaggacatgccagttctgggaacatcacactcatcgtgacaaaacatcagacaaacccaaacggatgaaatgtgaggaaaatctgtagttggttttacgtggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagaggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagcaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccggaggaaatcagagtggtgttctactagaaggccgatgactcctgggtaaagtgccaatgctcacctccatctctgcaagctcagtccctcgtggaatttccaggagcacaagggcaatctcgacagctccacgttcccagtgcccgacccaagcctggcccatgatcagataaatgcctaagtggggtggcatggacatttgcacacgtccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcagctggtgtaa

SEQ ID NO: 120276 - DNA, 2349 bp, Homo sapiens
  Payload ID: 3578
  Gene Symbol: CNDP2
  Gene Name: CNDP dipeptidase 2 (metallopeptidase M20 family)
  Uniprot ID: Q96KP4
  ENST ID: ENST00000324301
  CDS Start-End: 114-1289
gaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaa

SEQ ID NO: 120277 - DNA, 572 bp, Homo sapiens
  Payload ID: 3578
  Gene Symbol: CNDP2
  Gene Name: CNDP dipeptidase 2 (metallopeptidase M20 family)
  ENST ID: ENST00000582666
  CDS Start-End: 309-572
gtttttaaacaggtactgagtgtaaaacaatatgagagggtctctctcttccctcagtacaaacagtttttaaaatctttaacccaaagcacacgtgatgggtctgtcctatttccaatcagcctgttcaactgcagcagccacagagggtgagcctggaatgtggcaacgttacgggagcctcttctccctcaaggacaccttttcagaatccctcgttgcttcttgtccacaaacagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgact

SEQ ID NO: 120278 - DNA, 1176 bp, Homo sapiens
  Payload ID: 3578
  Gene Symbol: CNDP2
  Gene Name: CNDP dipeptidase 2 (metallopeptidase M20 family)
  ENST ID: ENST00000579624
  CDS Start-End: 1-330
gacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaa

SEQ ID NO: 120279 - DNA, 2653 bp, Homo sapiens
  Payload ID: 3578
  Gene Symbol: CNDP2
  Gene Name: CNDP dipeptidase 2 (metallopeptidase M20 family)
  Uniprot ID: Q96KP4
  ENST ID: ENST00000579847
  CDS Start-End: 163-1590
gttggtggccagggcgaccgcggggcgggccagcgccgggggtcgtggccgggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaatcg

SEQ ID NO: 120280 - DNA, 551 bp, Homo sapiens
  Payload ID: 3578
  Gene Symbol: CNDP2
  Gene Name: CNDP dipeptidase 2 (metallopeptidase M20 family)
  ENST ID: ENST00000581912
  CDS Start-End: 387-551
gtgtggcctcttggtcaggtgcttgtggaggtttagctgatgccctttggctgtttctggactaagatcatcaactttcttaaactgaatctggttttccttgggctctgtcgtctgtgttgtgggtttgtggtggtggacacaggatgtgacattcttgctgggatccctgaagtgactatatcctctgcaataacagaaagtgaaacttatctttgtgctttaagagtgtaaaaatttttattaaagtaccagtaaaactaaaagtgcctacttttagttttcactgtattttcttcaactcaggccctccctctgttgttacctgccatctgacacggaattttgtaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttg

SEQ ID NO: 120281 - DNA, 574 bp, Homo sapiens
  Payload ID: 3578
  Gene Symbol: CNDP2
  Gene Name: CNDP dipeptidase 2 (metallopeptidase M20 family)
  ENST ID: ENST00000583216
  CDS Start-End: 127-574
atgcgcgctggagcctgtgtggcctcttggtcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaa

SEQ ID NO: 120282 - DNA, 539 bp, Homo sapiens
  Payload ID: 3578
  Gene Symbol: CNDP2
  Gene Name: CNDP dipeptidase 2 (metallopeptidase M20 family)
  ENST ID: ENST00000582589
  CDS Start-End: 155-539
aagatcatcaactttcttaaactgaatctggttttccttgggctctgtcgtctgtgttgtgggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagag

SEQ ID NO: 120283 - DNA, 1135 bp, Homo sapiens
  Payload ID: 3578
  Gene Symbol: CNDP2
  Gene Name: CNDP dipeptidase 2 (metallopeptidase M20 family)
  ENST ID: ENST00000583785
  CDS Start-End: 387-1135
gtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctcttt

SEQ ID NO: 120284 - DNA, 567 bp, Homo sapiens
  Payload ID: 3578
  Gene Symbol: CNDP2
  Gene Name: CNDP dipeptidase 2 (metallopeptidase M20 family)
  ENST ID: ENST00000583203
  CDS Start-End: 153-567
agggcgaccgcggggcgggccagcgccgggggtcgtggccgggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagcctgttcaactgcagcagccacagagggtgagcctggaatgtggcaacgttacgggagcctcttctccctcaaggacaccttttcagaatccctcgttgcttcttgtccacaaacagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacc

SEQ ID NO: 120285 - DNA, 568 bp, Homo sapiens
  Payload ID: 3578
  Gene Symbol: CNDP2
  Gene Name: CNDP dipeptidase 2 (metallopeptidase M20 family)
  ENST ID: ENST00000581513
  CDS Start-End: 198-568
gacacgtggtacggaaccggcgccgcgcttgctgctggtaacagggccttgcctagtgggccttccttcccaggcatggtggctcatgtgtgtaacctcggcactttgggagaccaaggcggacagatcgcttgagtccaggagttcgagaccagcctgaaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaa

SEQ ID NO: 120286 - DNA, 582 bp, Homo sapiens
  Payload ID: 3578
  Gene Symbol: CNDP2
  Gene Name: CNDP dipeptidase 2 (metallopeptidase M20 family)
  ENST ID: ENST00000577600
  CDS Start-End: 316-582
gaaccggcgccgcgcttgctgctggtaacagggccttgcctagtgggccttccttcccaggcatggtggctcatgtgtgtaacctcggcactttgggagaccaaggcggacagatcgcttgagtccaggagttcgagaccagcctgagtaacacgagcaaaccccgtctctacaaaaaatacaaaaattagctgggtgtggtggtgcgcacctgcagtcccagctacttgggaagctgaggcaggaggatcatttgagcctgggagacagaggttgcaaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgaccca

SEQ ID NO: 120287 - DNA, 595 bp, Homo sapiens
  Payload ID: 3578
  Gene Symbol: CNDP2
  Gene Name: CNDP dipeptidase 2 (metallopeptidase M20 family)
  ENST ID: ENST00000584613
  CDS Start-End: 229-595
gcgcttgctgctggtaacagggccttgcctagtgggccttccttcccaggcatggtggctcatgtgtgtaacctcggcactttgggagaccaaggcggacagatcgcttgagtccaggagttcgagaccagcctgagtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacg

SEQ ID NO: 120288 - DNA, 510 bp, Homo sapiens
  Payload ID: 3578
  Gene Symbol: CNDP2
  Gene Name: CNDP dipeptidase 2 (metallopeptidase M20 family)
  ENST ID: ENST00000579583
  CDS Start-End: 96-510
accggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgca

SEQ ID NO: 120289 - DNA, 547 bp, Homo sapiens
  Payload ID: 3578
  Gene Symbol: CNDP2
  Gene Name: CNDP dipeptidase 2 (metallopeptidase M20 family)
  ENST ID: ENST00000581272
  CDS Start-End: 146-547
agtgctggatgcgcaagggaatgggagcgtcgtgggacctccggagcctgggagatcagagggtggagtcagggccccctagttttggactccattgccgcactgcagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataag

SEQ ID NO: 120290 - DNA, 661 bp, Homo sapiens
  Payload ID: 3578
  Gene Symbol: CNDP2
  Gene Name: CNDP dipeptidase 2 (metallopeptidase M20 family)
  ENST ID: ENST00000580672
  CDS Start-End: 49-661
cacccctctgcctgtggctggattggtgggcgtggcgggggcgtggcgatgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgca

SEQ ID NO: 120291 - DNA, 743 bp, Homo sapiens
  Payload ID: 3578
  Gene Symbol: CNDP2
  Gene Name: CNDP dipeptidase 2 (metallopeptidase M20 family)
  ENST ID: ENST00000582260
  CDS Start-End: 151-420
ggcgaccgcggggcgggccagcgccgggggtcgtggccgggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaaggtactgagtgtaaaacaatatgagagggtctctctcttccctcagtacaaacagtttttaaaatctttaacccaaagcacacgtgatgggtctgtcctatttccaatcagcctgttcaactgcagcagccacagaggaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccag

SEQ ID NO: 120292 - DNA, 536 bp, Homo sapiens
  Payload ID: 3578
  Gene Symbol: CNDP2
  Gene Name: CNDP dipeptidase 2 (metallopeptidase M20 family)
  ENST ID: ENST00000577355
  CDS Start-End: 1-375
gaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgt

SEQ ID NO: 120293 - DNA, 897 bp, Homo sapiens
  Payload ID: 3578
  Gene Symbol: CNDP2
  Gene Name: CNDP dipeptidase 2 (metallopeptidase M20 family)
  ENST ID: ENST00000584768
  CDS Start-End: 34-507
ttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggtatgccccccacgctgacttctgcctgagtcctgggttccatctgagccatacaaagacaggctctctgttcacacaacagcttataaagctcacaggaaaagataagacaagcgtcccccagcccttatcagcacagatgactcggatgtaagagtataggtttgttttccagctttaggaaacattcaaagtgtaattgttttacagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgta

SEQ ID NO: 120294 - DNA, 536 bp, Homo sapiens
  Payload ID: 3579
  Gene Symbol: CNKSR3
  Gene Name: CNKSR family member 3
  ENST ID: ENST00000424998
  CDS Start-End: 1-536
aacattaaacctggggaaggcctgggcatgtacatcaaatcaacctatgatgggttacacgtgattactggaaccacagaaaatgtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccac

SEQ ID NO: 120295 - DNA, 2023 bp, Homo sapiens
  Payload ID: 3579
  Gene Symbol: CNKSR3
  Gene Name: CNKSR family member 3
  ENST ID: ENST00000479339
  CDS Start-End: 352-1779
acatgaataaacacggtgcagtccagaggggcagaagggagaagtgatgaatcttgctggtgaggaagctggtgcgtggttggtgtccagagaaggcctcaaaaaggaggagaagcttctggggagccttggaggatcaggaggagttggccagaccagatagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtctt

SEQ ID NO: 120296 - DNA, 21063 bp, Homo sapiens
  Payload ID: 3579
  Gene Symbol: CNKSR3
  Gene Name: CNKSR family member 3
  Uniprot ID: Q6P9H4
  ENST ID: ENST00000607772
  CDS Start-End: 546-2213
aactttgcaacccgagcgcgcacgctctgcgctcggccctgccagggcggcacgggagggcggcgcaggaggtgggacctgcgccgggaaggctccgggacgccagcgcacgcggagcggggaccccggagagccagcaggcgagaagaccggccgagggagagccgatcgcgcctcgagagatccgaggaagtggtcgcgggccgggaggctcccgtgccgagccgaggccaggggtctggggtcgcagcccggcgtgcctgcagctgccgtcgctcgggagcagcagctgtgcccgggatcccggcggcggcgggggaaggaggagctgcagctggactgtggcagctggagggagagggccgggctcccctggcggagccgcgctgggacgactggctgaccgcggccatgcagtcttgacggagtcgctcgggcgcaggggagcagccgcgggcgcgccctcccgggaaggggcaccggagcgcaggcagcagcactttatctgcgactctccagcccagcgagaggcgaagcggtttaccatggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaaggggaggatgccctttgccggtatttcagtaacgagcggattcctccgatcattgaagagagctcctctcccccataccggttctccagacccacgaccgagcggcatctggtccggggtgcggactacatccgaggaagcaggtgctacatcaactcagatctccacagcagcgccacgattccattccaggaggaagggaccaaaaagaaatctggctcctcagctacgaagtcctcgtccacagaaccgtccctcctggtcagctggtttacgcgcctcaaactgttgactcactgagagggaccctgctcaggccacctgcctggctcctgccccaagtgccttgcttttacagtggacagcctcttctcgtttcagcctcagtattatgtagggaccttatgcaatttctttttcttttgaaaagttatctactgcccttcttggaagtttgcaggattggatgggaacaaattcagaggatcttaggtgctggcttgtggagacaaaaggagggaaatgggtagagcctgtttgtcttgcttccccagagatagaatgtgaagacacgcgctagaaatcgcagtcctggccagagacgttatggtcattgtgagggactggtggcattgttcctttttgaggggctggggggactcaaattggtggctgttttcacacagatgtgttggtttgtggtccaacttctttatctgaaaaagccagtgagaaaacatttttgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataaaccctcccaagcattttgggattttatggattagaaatggaagaacaggagaagcatatgcaaagtgaaattgcacgaggggaattttctgaggtatcttcctaggcagagccgaaatctcctactccaaaatgccctttctcataccaccggaattgttgagtttgctgaactgcctggaattcagcccatgaaaatcactggagttaggaaacatcttccctttaaaatgcttctggtgtggttaaaggaactagcaaccactcatgtataattactgtgactgaattcagtcaggctggttttttttgtttgtttgtttgtttttgagatggagtctcaatctgtcacccaggctggagtgcagtggcgcaatctcagctcactgcaacctccaccttccaggttcaagcgattctcctgcctcagcctcccatgtagctgggattataggtgcccgccaccatgcctggctaatttttgtatttttagtggagacggggtttcactacgttggccaggctggtctcaaactcccaacctcaactgatctgccggcctcagcctcccaaagtgctgggattacaggcatgagccaccacacccggctcagtctggctgttttcttctctacctctaagacaactgccatgaagatctggtatttcggcctggcgcagtggctcatgcctgtaattccagaactttggggggccaaggtgggtggattacctggggtcaggagttcaagaccagcctggccaacatggtgaaaccctgtctctactaaaaatcagcttcgcatggtggtgggcacctgtagtcccagctactcgggaggctgaggcaggagaatcacttgaaccctggaggcggaggttgtagtgagccaagatcaggccactgcactccagcctgggtgacagaaggagactctgtctcaaaaaaaaaacaaaaagaaaaagatctggtatttcatggagacatggagacccaagggtgtttggcagatggagagaagaggcttgcagtgtgtgaccacagggtgttcaacacactaggagggtggggtgtgggctggggaggtctcgtgtagggcactggtgatgaggagggagctgtgtacgaggggcgagccagccctgcctgttttactcttgtcttgagctggctttatgcccaggaagtgggtggcaacatctcctcttactccccagattgtggggagaactctaagagctgtagttccactggatgatgagttaaatcactctggaggccttagctggctggtgagctctttttctgtggggaaaatgccacttgtgaattgaacagccatcctttaagtgaatattcggcagtcagtcttcattataggcagtggccaaccagattggtgcttttcagcctttgttccctggagtcccaggacccgcgagagaagttcctggctcctctacttgcagtcaccctccacagcttcatctttctttttatttgaggttttctcctgaattgtgtttgaaaaatatattgctgctaaaaaaaaaaaacctttgtaaacctctactatggacatacataaataatagtttaatatggatttcttagaaattaatggaaactgcttgcctcagtagtaatccaggtttaattgtggacgtgtgttcacatatgaagttgcttgatgatgctttttgacaggattctttatttttatttctttaaaaaaaatttttttttttttctgagacagattctcactctgtcacccaggctagagtgcagtggtacaatctcaactcactgcagcctctgcctcccaggttcaggcaattctcctgcctcagcctcccaagtagctgggattacaggtgcccgccaccacacctggctaatttttgtatttttagtagagatggagtttcaccatgttggccaggctgatcttgaactccttgacaggatactttacaagagtgattgttaaaactctcccagacacaactcaacacctacccctattataatattttatagcatcacttttcaatcttcaaatgaaaatcatggatgatgaagcttaccttcactcataaaaacatcactccatttactattctgaaatgaaactagcaggtaatataactagcctctaaaacatacccatcagtgacgttctaactgaaacagataagatattttataatgaaataattattttcatatgtacatattctagcatggttatattacaagatgtaattaaactactaagcagggcacatactttgtatgtgtgtgtataaatataaatatgtgaaaaatcaccatgaatgtggtagttaccaattcagacctgctgcattggcagttcaataccaggaaaggggtcgatgtcagcagtatgattttctaaaatgtggccaattctttagataaagttctaggcatacctagtctgtaatggcttcactcatatagtgcttgctgtgtgcctggcattgttctaatacctttctaataaatctatgaggtgagtactgctgttagtcccgttttgcatatgagggagttacccaggttatgtgctagtcatcctggttatgtgctaataatggcagagctgggattaaaatgaaagcagcctggctctggctttcttgctcataatcactcagtatataggcttccttccatttatagaattctctcattgcattcttgaaaaatccaaagcatattaaaactgggctgaaaattctgtgtgtttatatataaaatgaaatgagatcatagatttgttattgtaaactgagttcccatctatatgaatattgggcggggcaattgaaagttgtgttgatgagtcagctctttgttgtgagggctgtaagctgcagggcttgtgtatcacgcatgctccaacaggttaaatctcagtagtggccgcccatcagtggcacccctaacatgctcacatttccagaactgcctcttgggcggaggtgggggagggtaccatctctttcagaacaagtattttaaaagaaatcctgtatcctccttaagtagtatttcagtctatatatttgtccatttcctatctctgcttctctctcagttctttccccaccaaacctgaaatttcagaatctattttgtgggctttctttttttaattttttccctggaagaccatgaacattcctctttaggttgttagtattgcagcaaaccctgaggtattgacacaaaacttttcatccgccaaagagctcgagtaagtaaatctgtctgacatttgaatgtcaccagcaaagcatgagactcatgctgccttttgccaccataggcatgaatggtatggagaagtaggcctgacttgttttcttctattgtagatgagattagttttgtagaccattagttcacattttgctcctacccttgtgcataaaatcactgcatcatttccgtggggatgagactactgcaagctacttccttggagattctgtggaagatggacatcttaaaagtaaactacttttggtatgactgctcattggcttggccagtgatacttgatgttatttattttgtgagttactctgtgtcttaatcagctcaggctgcaataacaaaataccatacactgggtagcttaaatgacagaaatttctcaccgttctggaggctgggaagtccaagatcaaggtgagttcctggtgagcacccttaccctggtttgctgatagccatcatcttcccattgcatccttacatggcagagagagagaaaggaagcaagcaagctctcctttcccttcttgtgagggcgctaatattcatgagggctccaccctcaggacctactcacttcccaaaggcccacttatggtattagctccgcctcctaataccattgctttggagattagggtttcaacagatgaattttgggaggacataaacatgcaatccatagcactctgcttttgtatatttttcaaacctttcatgctaatcagctggaaggtgaatattttaaaatctattttaaaactggcttaaggagcacacaaaagctgatttctgatgtttcttccaatacgtggaaaattttgcatgatgtattaacccctagttagggtccctcaaccccagttgaggacctcaacacacatttggtaatacctaagggaatttaaatatatattttgtagcctatagcatatggaattagaaaaaaattagtctctttactgtaaaatttaccttttaattatttggaaatttcacaattgccaagtttcaacttaaagtttctatttatttggggccagaattattgccagaagtgtgctaatttgacaaagggtaccttttacataagtaaaggaaaaagtgattacatcatgttcagacctgctagagggccttgtttttcctctagttttaggggtgtggagtctgtcccaaaccctatatatgtgtgcatttgtgtatgtaaaagacaaattttttatactcaaaagtttgtcttaaataatggcctatggcctactgatttggatagaggagagaaattttgtctataagcaacaaaaaatgctacacagccaggagactgtcacacacagtttttcagaacctttgggccacatactgcactccccttccatagaaatacacatggggtcagtgattaaggactcaattctggttgtgacttggccatccataggcatattctaaagttctatggcaacctttatgaagctcgtcttctgagttgatcacctgttcatgcgctgcccatttacaacatacctcagggattaaaacgtgaggctacacctaaggaaagtcggtcctaatcctgcgtttcctcctgcatgtcactgaccattggagtcactgctctctgaggaagacagtttacagcctgagcattcatgtcacgctcacagccaacctgttacttgctggcctcctttaccaagctccttgtttcatgaagaagttgtgaaactgaagttggaggaaaaaaattaagaaataaacctcaaaggtatttaaaagggcagtagagtaattactcctcacacccagggataaggatattctcatcattttctctcctcttgcctggagcataaacattcagatgtttgtgaagaaatgattaaaaggagagaaaatatcaggagaaaaatgattaaaatgagagaaatgttcttccactgactagacccattaaaggggaggatttaactttattgttagaggggtgaaaactggattttaagatatttcttcaccattttgacatatcttgggctgaacattttgattattttagagaatcagggagcttcagaaatgaagtttaatataaagtaagattgtctctgaaggaagaaattgtccttttaactcagtgtcaggttccgttttcttactcatatctaaacttcctgtcactccaactgaggctgcaccaggataagaggagggatttgaggaattagcgcgaatttagaagcctttgacttttgggaatttgcatcaagcagatagaagcaggcgggggctcagcttttgaagttggatcatccagctgtctcactttgccacttatgggatctgtgacttgaagcaggtgactgacctctccactcctcagttatctatgaaatggggataatactagcatctacttcgaaggcttatggtgattaaatgagataatgtttttaaggccctttcttcgcatagtctggcacacagcatttaagagatgttgactcgtgttcctgtagtagcagtactgactccatctcagcctctagtgaataaggtattcagagctggccaacaggaaattgctcattcttttgtccataagcagcaaaataatgccagtgtgacactgtcagagggctgcagtgtggtcagtggcctagagatgcagcttttactgttagaaaactcactcggatgttttagccgattcagaactcaagaaatgacaaaagtctgtgattggacacacttttttttttttttttgagacggagtttcagtcttgttgcccaggctggagtgcaatggtacgatcttggctcaccgcaacttccgcctactgggttcaagtgattctcctgcctcagactcccaagtagctgggattacaggcatgtgccaccacacccggctaattttgtatttttagtagatggggtttcttcgtgttggtcaggctggtctcgaactcccgacctcaggtgatccgctcacctcagcctcccaaagtgttgggattacaggcgtgagccactgcgccccgcctagagtattctttcaatattgacttgatttgtcatcatcatatcttttctattaaatcccttccacttccttcaatgaaatcgtatatgaaaacaaagggaatcggagcattttgcccacctcctagttggctgaattatttttgcctcccattcccatcttgaagtggtattcctcaaactcgtttctatgtttcctgtggttttaaataaaggaataatgtagaatggtatctattttggacattctcatcgtgaaaaggaactcttacacaaatacaaagccaagagattgtgttgccattgttgaagctgaaaaggacagtcactggatgcctccccacccaaggccaaggctttggtaggtccaggaagtgaaaaggaaagagaagctatgggagagacaaagggaagtaaaaaatggttgttcggctcagcataacaatcacttttgtggggcttattggttgtgcataaatttcatccatttgggcacacacacagatgtgacacccagaccactcagacacttggctaacactgatgccgtcatcctgaatgttgtttctggaaggactttcatgaatagaatctatttcagattggccgtaagtctcgatttattgatccgcaccactggactggggtggggttgtgtccactttttccctgccccttccctgctttggctcttgtgattgtgtcctccgtgtgtcaggcagagccctgtgaaggtgtggatatgtggccatattttacctgcataatctgcagttcatatgattcagcctaatgggttgcaatgccctgaggacagagaccatactttttcttcctttgtctttttagcgaaattcaatcctgttctgcgcctgcgccacagttgcaggctgtactgtctgccctgtgcatctcacacacccccactgcactgtgcacctagtgatggccgcagatttgcttttactcatcttccagggcctaccctgttaattccatcacagttgcaggctgtactgtctgccctgtgcatctcacacacccccactgcactgtgcacctagtgatggccgcagatttgcttttactcatctgtttgcagggcctaccctgttaattccatcacagttgcaggctctactgtctgccctgtgcatgcatctcacacacccactggactgtgcacctagttgatgaccacagatttgctcttacccatctatttccagggcctgccactgttaattcctaggaaaaaagaaaaaacaagcatggtggattggttaaattggcattttatattgtttgtgttcatggccatgccaatgataaacaagagctggtcatgggcattcagatcagatgagcaattaaatcccctccaaaaaacagaaacctacttttagagaagaaaagaattaaaccaagatctttcagggttttgcttctccttttgtttttaaggcacttaaataaatggaagaacatgtaagctaaccgtgtttagagtactatgttttactagaaagtgctacccttctgcagatttctcctcaatgaaagaatgccactgaagcacctttaatggtgcctttatcctatagtcttattgaatcattctctttagccaacataaaatacaaagccagggtataagacttcatgtaggtggtaatttaaactaacaattagtgaggccgggcgcggtgggtcacgcctgtaatcccagcactttgggaggctgaggcaggtggatcacaaggtcaggagatcgagaccatcctggctaacacggtgaaaccccgtctctactaaaaatataaaaaaaaaaaaattagccgggcgtggtggcgggcgcctgtagtcccagctactcgggaggttgaggcaggagaatggcgtgaacccgggaggcgcaacttgcagtgagccgagattgcgccactgcactccagcctgggagacagagcgagactccgtctcaaaaaaaaaaaaaaaagaaaacaattagtgaatttttgctgatgctttccttaaaccccttacttagcacttagttctggattcttaaatcctgataatggactcatccttctcggtctagttaccccagtaagtcccaaggtcatccatatgaggtcctccttgatcttactctgaatagaattaactggtctcttctgtttttccatagcattgactcatcgtgttagaccagcttgaattgtgagcctttctaaagcagggtctgtataatttacccttatatttgctctgtaggcagagaaaatattattgaagtaactagatggtaaaattaactgtgcaatcagaaaagaagttagaaaaaattattaaaattttctgtgaaaattgttttaattttattaatatattaaagcattttgcagactattccataaagaattttattacattggctctcattttaaagaaaacattataccaggtgtcagaactcaatcatatttgtaggaagaataagccttggccatcaacaacgcttctttggttacaggattacaggaactgctgagaatgtaagcactttccgaagtccacaaagaactcatttaaagctcgtacaggcagtttcaaattagccagggaaaagttaatggtggggaggtaaggtcatagaatgctctataaatggaggcgacgtggaggacagttgcagttgtataacatttgattgaaggagagggatttggacctgaggaaaccaggtctataaatactaaggctggctgggcacagttggctcatgcctgtaatctcagcattttgggaggctgaggccggtggattgcttgagcccaggagtttgagaccagcctggacaacatggtgaaaccctgcctccaaacaaacaaaattaaccgagtgtggtggtgtgcacctgtagtcccagctactcaggaggctgagatgggaggatctcttgagcctgagaggtagaggctgcagtaagcccagattgcaccactgcactccagcctggtgacagagtgagactccatctcaaacaaacaaaacgtacatgcatatataggctgtagactaaatagtgaaatattactaagaaccttcatcccaaggggttgagtggtagaaccactgagaatattgttgctgctcttttggagacaacaaactgcattaataaaagtctgagaacaagaaagttgagttttcaagtaatgtcctttgcatattgctacatagggctcatctgagtctgtgatgttctactttgttgatgaaagaaaacaagtggaaattctgctcccccacacatcctgcactgcaaaaagataacaagtagcaggagatactcaattatgatgcagttcaacaaagaaaacaaattaaaataaagagatcctgggtggttaaatacagagtctcctttgtaaacagcaatggatgatgatgatgactgttaccagggctctgtatgatcattttcccaattctttggagtacttttttcaaaagcactcttgtagaattaactggaaacatagactacccttcactcattacatgggaaatgggattgaattctcttcttggcaatggaaaatacttgatgcatgcaaataagaaaactcttactttttccttctctccttgcagggggagcacgcgtcctaagcttgccaggaagccctgctctcctgccctgggcacctccgttccacttgaccttttccacctgtactccctgcattttggtctcttgctctggtctttagccttcgcattttcctgatgcagcccaaaccagtcacctctctcctagattcattctctgtgctcagaccatctctttcctttagttcctgtgacgaaagaaaatgtatttggccattggaggtataagcaacaaagaatccaacccacacagctttatatatgcaggttctctatatgctcttcttgtgaacagcgtggggagaggaaaatagacttggcaagaggactaagaacagaatcggacagttatctgatggctttcctaaggttcaggaaagaacagtggtccctttgttgggcctttctgttgtttctttgttttcaatttcactgatttctgctttttattttctattttcttctgtttcctttggaattcttctttttttttttttttttttttacttcttgtattaggctcatgctataacaaacaacccccaaatctcagtgactttacacactaagagtttacattttcctcatcaacgtccactttggatgttccaggttgggtaatgctctgtggctgtcctctagctagtgactcagggacttgggttgctcctggtgtctccagcgtggttatggtgtctccaattttggacttcaaggtgacccaggcattatccacctggtaaattgggagatgggtcccaggaaagtgaatactcaaccaacctggcctagaagtgacaataataaggccatgtgtggtggctaacagtcagaaacccaacaattgggagattgagctgggaggattgcttgagaccagaagttcaagaccagctgggcaccatagtgagaccctatctttcaaaaaaatataacaaccaggcttggtggtgtacacctgtggtcccagctatttgggaggctgaggtgggataatcgctggagcccaggagtttgaggttacagtaaaccaggtttacaccactgcactccagtctggatgacaaagcaaaaccctcatctcacaaaagaaaagaaatgacaatcacagccactgcaacttcaaggaaggttgggagagtgatattggtcaggatgagtggtctctgacatgtttcttaagttggatatttagcttattaatttacaactcttttctaatattaatactcaagactacattttccccaaaacatttattttgccatgttttgcaaggcttggtatatggcattttcattactctttaattctaactaatttttaatttctattatgatttattatttgatctatgaatcattttgaaatttgtttttgtaaccttggatagggaaagatttcttatagaagacagtaaaagggctgagtacaaaagaaaagactaataaattcagctacgctaaagcttagaacttttcctcatcataggacaccttaaagaaaatttttaaaaagttacaaattgggagaagattaaaaagtcctaagggttagcagtaagaatatatacatataattattacaaattggcaagagaatgacaaatcaacacaaaaacgagcgaaaaggcattttgcaaaagagaatcagatggtccatatgcatgtgaagcgattttcactagcgagcagggaaagtgaagtcaaaatcacagggagatgctgctctctacctgactggcaaaactgaaatgattagaaaatacttggaggatatcctagaacgatcagtgggatctggtatattatgtgtatgaggttaaattagcagtgagtattcacataccctatgactcagcagtttcattcctagatatatatcctggggattagaaacactaagtaggtgggtgcagtggctcacacctacaatcccagcactttgggaggccaaggcaggtggatcacttgaggtcaggggttcgagaccagactggccaacatggtgaaaccccatctctactaaaaatacaaaaattagccaggcgtggtggcgggcacctgtaatcccagctacttgggaggctgaggtgggagaatcgcttgaaccccggaggtggaggttgcagtgagctgagattgtgccactgtactccagcctgggcgacagaatgagactccatctccaaacaaacaaacaaacaaacaaaccactaactacctcagaggacaatgctaacatttcaaagtgttctagaagttggtttcccagaaaagaagtcaggctcttgtggagctccatggaaactggcaatgacccatgacttagggcagtgaagtctcatcaaatgcaaggcttagaccccattctgctgctgccgtcaggggaggcaagggctccttgttccccaaacatcgatgctaatgaagcaaatcctgctgctagtttgcagtgttgcctagctgcaaacacaacctctgatgatgccaatagagaggctggtgcctccttcatcatagagcttacaatccccacaaggtttcgggaccctcttttggattctgagggtgggctcctttagccatctgtttagtgccccagatgaaattgacagcaggggacctgcactccttctactgctttttctcaaggcatccccagcagagggtctctagggtgcctgttatgtgtgctgtttggccatctgcctttgtagaacacagcccaatgtctgttggcaaaaaaaggtttacatgtggtatattcttaccatggaatattctgcagcaagtaaaaatgaataaattacagctattcatatcaaagagatggattttattaatatagtgctgagtgggaaaaagcatcagaagacaacatataatggtacactctttttttttttttgagatggagtctctctctgttgcccaggctggagtgcagtggctccatctcggctcactgcaacctccacctcccaggttcgagcgattctcctgcctcagctgcccgagtagctgggactacaggtgcgcaccaccacaccaagctaatttttgtatttttaatagtgacggggtttcaccatgttggccaggatggtctctgtctcttgacctcatgatccgcctgcctcagccttccaaagtgctgggattacaggcatgagccaccatgcccagctacattctttttaaacattcagaaacaggtaaaactgaaaaatatataatttagacacaacacttatgtgaaaagaccaagtttaggatgttggttacctgtgacggggcagcaagattgtgggaaaggaaggaagctacaggtatgtgacagagagttgcattagcccaaatctctacagagctggtgtcaaggatgaaactattggtgttttatttggaagatacaagcccaaggcgaggtgagaaaaaagagaagggaagcaaaagaagacacaaagtgacacaaaatggcatgaactaaattacgttctctccaaattcacatattgaagtcctaaccccagtacctcagaatgtaactgtatttggagattcggtctttaaagaagtgattcaggctgggcctgattgctcacgcctgtaatcccagcactttgggaggccgaggcaggcggatcatgaggtcaggagattgagactatcctggctaacacgatgaaaccctgtctctactaaaaatacaaaaaattagccagttgtggtggcaggcgcctgtagtctcagctacttgggaagttgagggaggagaatggtgtgaacccaggaggtggagcttgcagtgagccgagattgtgccactgcactccagcctgggtgacagagtgagaccccgtctcaaaaaaagaaaaaaagtgattcagttaaaatgcagtcattatggtgggctcaatcaaggacatgtggacacagatatgtatgcacatggaggaaagaccatgtgaagtcggggagaagaaaaccagctacacactaaagaaagaggcgtcaggccgggcgcgatggctcccgcttgtaatcctagcagtttgggaggccaaggtgggcaaatcacttgaggtcaggagttcgagaccagcctggccagaatggtgaaaccctctctctactaaaaatataaaaattagctgggcgtggtggcatgtgcctgtaatcccagctacttgggaggctgaggcaggagaatcacttgaacccgggaggtggaggttgcagtgagccgagatggagccactgcactccagcctgggcaacagagtgagactccatctcaaaaaaaaaaaaaaaaaaaagcctcagaagaaaccagtgctgctgacaccttgatcagtcttccacctgcagagctgtgagaagacacatttctgttgtttaagctacccagtctgtggtattttgttatggcagccccaacaaactaatacacaaaatgatgcacagccttgctgactatcacttcaaaatgagccaaacagagacacaacggggcactaggcaattgtgtcccactcagtgaaacttctctggaaagctgtaaggtatagtccagagacgagaggaagggaagaagaaatttatcctctgggagcctcccatttcctgtctcctaatagtgagaatttttccatgagaagttaatgtccctatactttcacaatgtgttaccttcttttgttgctgttcaagatgccaagcctatgccctgcagtgtggccttttgtcagagtccataaagggcaggaggaactaggaactctgggtgtgtatggttggcccagctgcagagttgacagtcaaggggataaccaactctaatcagcctagaagggaacttggtagcctaggtgagttggtcaggcacaggctggggctaaggcaaggcaaatggctgaggtctaagacgtaggtggtgctgagaaaatgtggggaagcatacaagatttgtgactgatgagtaatattctagttcttggttaggataatgggtacatggggtgttccttttattattttcaaaatgaaatgaaataaaagagggatatgtgtggactgatgatgatgtataatgaatcaaagattatgattaacttaactctgcatacttgagtttgtttatttttctataaaaggagaatagcaatattaagtcttacagcccaggaatgaaatgtctttccatttgtttgtgtcttctttaatttatttcatcagtattttgtagttttcagtatacaagtctttcacctccttagttaagtttattcccaagtattttattattttgggtgctattatatatgggattgtttcgctaatttcctttttagatagttctgtgttaatgtatagaaatcgcaactgatttttgtatgttgattttgtattatgcaactttattgaattcctttattctaacatgtttaaaaaatggagtcttagggcgttctatatatgagacgatgtcatctgaagacagggacaaaacaattctacagtccatatgaaaccacaaaagaccatgaatagccatatcaatcttgagaaagaagaacaaagatagaggcatcacattgcttgatttcagaatgtataacaaaactacagtaatcaaaacagtatgttactggccaacagatagacatatatgtgaatggaacagaatagagagtccagaaatagattcacatgtatattgtcaactgatcttcaacaatggtgccaagaatacataatggggaaaggatagtctcttcaacacatggtattgagaaaatcagatatccatgtgcaaaagggggaaactggacttttatcttacatcacatacaaaacccaactcaaaatggattaaagatttaaacataaaatctgaagctgtaaaactcctagaagaaaacataggcgaaaagctctttgacattggtcttgtcaatgatttcatggatatgacccccaaaacacaggcaacaaaaacaaaaataagcaaagttacatcaaatcacaaagcttctcacagcaaaggcaacaatcaacagagtgaaaagaaaacctatgaaatgggagaaagtatttgcaagcgatgtatgtgataagggttgacatctaaaatatgtaaggaattcataactcaatagcaaaaaaaaaaaaacccaatttttacaaatgggccaaggatctgaatagcatgggctctggcatcttgaacagcaatgaaagaagctagttgacacattgcgagagtatagggatattaacctctcatgggcaaattctcatcaatgagaggaaatgggaggctcccagaggataaaaggtgctcatcatcactgatcatcagggcaatgcaaatcaaaaccaccgtgagatatcaactctcacctgtcaggatggctatcattgaagaaccaaaacacaacaaatattggtgaagaagtggacaaattggaacccttgcatactgttgatgggaatgcaaaatggtgcagccactaaggaaaacagtatgggtgttcctaaaaaatgtaaaaatagaactgccatgtgacctagcaaccctatttctggatatttatccaaaaaaattgaaatcaggatcccaaagaggtattagcatttgcaggttcattgccgcattattcacaatatccaagatacacaaacaatctaagcgtccatcggcggagaaatgaataaagaaaatgtatatacacatacaatggaatactatttagcttttaaaaagaaggaaattctgcaattattcaacaacatggataaatcttaaggacattacgctaagtgaaataaactattaacagaaagactaatatggcaggattcaatttatgtgggatatttaaaatagtcaacttcatagaaccaaagagtgaaatgatggtggccaggggctgaggggagtggggagttactaatcaataggcataaagtttcagtgaagtcaggtgaataagctctagagatttgtggtacaatattgcacctatagtcaacaatactgcagtgtacactgaacaatttgttaagatagatctcaccttgtgttcttactgaaaaaaaaaaagaaagaaaatagaacagaaaagcaattggattttaattctggaaactcctttctcttccttacatccaggaaatttgctgtttattttgaaaagcaaatttaaacctatttaagggagagagagctcttgtaaaaattcatttattagttctggaccaatgttatttataagctattatttcaaatgataaaaaataaatgcataatacatttgatgatagaacatttttctttttaaataaggcctgatttttcaaaaagcattgaatatgtttgtttctaatttccaaagcttgacagtttcttatgtttcattaaaagcagaagaattgttatgtatgcatgttcatatcacttttgaatgactcatgtggctacaaatgcagcaatctgtggttatcatggaccatgaactagataaacattcctgcttttcttaacattcctttcctgtgcctcattaactaatgtacataataaaacatctttatttcattttctttgca

SEQ ID NO: 120297 - DNA, 2700 bp, Homo sapiens
  Payload ID: 3579
  Gene Symbol: CNKSR3
  Gene Name: CNKSR family member 3
  ENST ID: ENST00000616478
  CDS Start-End: 1-2700
atggaacccgtgaccaagtggagccccaaacaagtggtggactggactagagggttggatgactgcctgcaacaatatgtccacaagtttgaacgagagaagatcaacggcgagcagctgctgcagatttcccatcaggacctggaggagctgggggtcacacggattggacaccaggagcttgtgttggaggctgtggaccttctctgtgcactgaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccgggctccgtttacagggatcactgatttctcagtcacgaagaacaaaattatccagctttgcttggacctgaccactacagtccagaaggattgctttgtagcggaaatggaggataaagttttaactgtggtcaaggttttaaatggcatctgtgacaaaacaatccgatctaccacagatcctgtgatgagccagtgtgcatgtctggaggaagttcacttaccaaacattaaacctggggaaggcctgggcatgtacatcaaatcaacctatgatgggttacacgtgattactggaaccacagaaaattctcctgcagacagatctcagaagattcatgctggtgacgaagtcattcaagttaatcagcaaactgtggtgggatggcagctgaaaaatctggtgaagaaattgagagagaatcccaccggagttgtgttactgcttaagaagcgccccaccgggtctttcaactttactcctgctcccctgaaaaacctacggtggaagccacctcttgtacagacctcacctccacccgcgacaacccagtcccctgaaagcactatggatacctcactgaagaaggagaagtcagccatcctggatctttatattcctcctccgcctgctgttccctactctccccgggatgagaatggcagttttgtttatggagggtccagtaagtgcaaacaaccattgcctggtcctaagggttcagagtccccgaattccttcttggaccaggaaagccggagacgaagattcaccattgcagactcggatcagttgcctgggtactcggtggaaaccaacattctgcccacaaaaatgagagagaaaacaccatcttatggcaagccacggcctttgtccatgcctgctgatgggaactggatggggattgtggacccttttgccagacctcgaggtcatggcaggaaagcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttga

SEQ ID NO: 120298 - DNA, 2458 bp, Homo sapiens
  Payload ID: 3580
  Gene Symbol: COASY
  Gene Name: CoA synthase
  Uniprot ID: Q13057
  ENST ID: ENST00000393818
  CDS Start-End: 457-2151
agccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctga

SEQ ID NO: 120299 - DNA, 2071 bp, Homo sapiens
  Payload ID: 3580
  Gene Symbol: COASY
  Gene Name: CoA synthase
  Uniprot ID: Q13057
  ENST ID: ENST00000421097
  CDS Start-End: 85-1779
cgttagtgcttccgggttgcagccagggaagcctccgcggtggtgcaagtggaacccaagccttgaggtttcagcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaa

SEQ ID NO: 120300 - DNA, 1976 bp, Homo sapiens
  Payload ID: 3580
  Gene Symbol: COASY
  Gene Name: CoA synthase
  Uniprot ID: Q13057
  ENST ID: ENST00000590958
  CDS Start-End: 126-1907
agtgcttccgggttgcagccagggaagcctccgcggtggtgcaagtggaacccaagccttgaggtttcatttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatggggg

SEQ ID NO: 120301 - DNA, 742 bp, Homo sapiens
  Payload ID: 3580
  Gene Symbol: COASY
  Gene Name: CoA synthase
  ENST ID: ENST00000586771
  CDS Start-End: 84-742
ttctccgttagtgcttccgggttgcagccagggaagcctccgcggtggtgcaagtggaacccaagccttgaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccagga

SEQ ID NO: 120302 - DNA, 625 bp, Homo sapiens
  Payload ID: 3580
  Gene Symbol: COASY
  Gene Name: CoA synthase
  ENST ID: ENST00000585811
  CDS Start-End: 354-625
gttgcggtttctccgttagtgcttccgggttgcagccagggaagcctccgcggtggtgcaagtggaacccaagccttgaggtttcatttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccg

SEQ ID NO: 120303 - DNA, 551 bp, Homo sapiens
  Payload ID: 3580
  Gene Symbol: COASY
  Gene Name: CoA synthase
  ENST ID: ENST00000587157
  CDS Start-End: 262-551
agtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcgtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcag

SEQ ID NO: 120304 - DNA, 570 bp, Homo sapiens
  Payload ID: 3580
  Gene Symbol: COASY
  Gene Name: CoA synthase
  ENST ID: ENST00000585909
  CDS Start-End: 276-570
gcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgc

SEQ ID NO: 120305 - DNA, 994 bp, Homo sapiens
  Payload ID: 3580
  Gene Symbol: COASY
  Gene Name: CoA synthase
  ENST ID: ENST00000591779
  CDS Start-End: 648-994
gttagtgcttccgggttgcagccagggaagcctccgcggtggtgcaagtggaacccaagccttgaggtttcatccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttgg

SEQ ID NO: 120306 - DNA, 539 bp, Homo sapiens
  Payload ID: 3580
  Gene Symbol: COASY
  Gene Name: CoA synthase
  ENST ID: ENST00000587214
  CDS Start-End: 98-539
agtgcttccgggttgcagccagggaagcctccgcggtggtgcaagtggaacccaagccttgaggtttcagtgagtagggggccgacgcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactgg

SEQ ID NO: 120307 - DNA, 569 bp, Homo sapiens
  Payload ID: 3580
  Gene Symbol: COASY
  Gene Name: CoA synthase
  ENST ID: ENST00000587858
  CDS Start-End: 186-569
agtgcttccgggttgcagccagggaagcctccgcggtggtgcaagtggaacccaagccttgaggtttcacttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctccc

SEQ ID NO: 120308 - DNA, 3330 bp, Homo sapiens
  Payload ID: 3581
  Gene Symbol: CARM1
  Gene Name: coactivator-associated arginine methyltransferase 1
  Uniprot ID: Q86X55
  ENST ID: ENST00000327064
  CDS Start-End: 191-2017
aggcggcgcgtggccggcaggcggcgctgcccggctcggcctcggcctgcacggcggctgcggcggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaa

SEQ ID NO: 120309 - DNA, 2722 bp, Homo sapiens
  Payload ID: 3581
  Gene Symbol: CARM1
  Gene Name: coactivator-associated arginine methyltransferase 1
  Uniprot ID: Q86X55
  ENST ID: ENST00000344150
  CDS Start-End: 1-1758
atggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaa

SEQ ID NO: 120310 - DNA, 596 bp, Homo sapiens
  Payload ID: 3581
  Gene Symbol: CARM1
  Gene Name: coactivator-associated arginine methyltransferase 1
  ENST ID: ENST00000590039
  CDS Start-End: 1-336
gcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagatgagaaaactgaggctcagagaggttaagtgacttgctccaagtcacacagctatatgcaacagagccaagatgggaagccaggtctgcctgatgccaaagtctgtgcccctgcccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaa

SEQ ID NO: 120311 - DNA, 468 bp, Homo sapiens
  Payload ID: 3581
  Gene Symbol: CARM1
  Gene Name: coactivator-associated arginine methyltransferase 1
  ENST ID: ENST00000588947
  CDS Start-End: 108-468
gcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatttctgttccttctacaacatcctgaaaacctgccggggccacaccctggagcggtctgtgttcagcgagcggacggaggagtcttctgccgtgcagtacttccagttttatggctacctgtcccagcagcagaacatga

SEQ ID NO: 120312 - DNA, 2240 bp, Homo sapiens
  Payload ID: 3581
  Gene Symbol: CARM1
  Gene Name: coactivator-associated arginine methyltransferase 1
  ENST ID: ENST00000590699
  CDS Start-End: 31-516
gcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagatgagaaaactgaggctcagagaggttaagtgacttgctccaagtcacacagctatatgcaacagagccaagatgggaagccaggtctgcctgatgccaaagtctgtgcccctgcccaggtgccacgctgcctcccgatcgcccgttgtcttacagagagacaccacacctcacctgcctggcgctctgagttctaggttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaaggtaacgagggtggcgggggcagggcccgtgggggccgagctagcgtgtgagtcgccatcctctgtccggccgcccgcctgccctcttgcctgccctttctctctctctgtgactctgcctgggggctgggcgggccagggcagcccctcactgccattgcctgctccacagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcg

SEQ ID NO: 120313 - DNA, 2766 bp, Homo sapiens
  Payload ID: 3581
  Gene Symbol: CARM1
  Gene Name: coactivator-associated arginine methyltransferase 1
  ENST ID: ENST00000586221
  CDS Start-End: 1-1030
cgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacagcgcctgtctggcttccccagcagccactgccctttgccttccaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcaca

SEQ ID NO: 120314 - DNA, 674 bp, Homo sapiens
  Payload ID: 3581
  Gene Symbol: CARM1
  Gene Name: coactivator-associated arginine methyltransferase 1
  ENST ID: ENST00000586298
  CDS Start-End: 1-531
ctggctttctggtttgacgttgctttcatcggctccatacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacactttt

SEQ ID NO: 120315 - DNA, 601 bp, Homo sapiens
  Payload ID: 3581
  Gene Symbol: CARM1
  Gene Name: coactivator-associated arginine methyltransferase 1
  ENST ID: ENST00000589693
  CDS Start-End: 1-279
gccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagatgagaaaactgaggctcagagaggttaagtgacttgctccaagtcacacagctatatgcaacagagccaagatgggaagccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaagg

SEQ ID NO: 120316 - DNA, 1843 bp, Homo sapiens
  Payload ID: 3582
  Gene Symbol: COTL1
  Gene Name: coactosin-like F-actin binding protein 1
  Uniprot ID: Q14019
  ENST ID: ENST00000262428
  CDS Start-End: 164-592
gtggaagccgccgccgcgctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaca

SEQ ID NO: 120317 - DNA, 1677 bp, Homo sapiens
  Payload ID: 3582
  Gene Symbol: COTL1
  Gene Name: coactosin-like F-actin binding protein 1
  ENST ID: ENST00000564057
  CDS Start-End: 270-491
ctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattg

SEQ ID NO: 120318 - DNA, 531 bp, Homo sapiens
  Payload ID: 3582
  Gene Symbol: COTL1
  Gene Name: coactosin-like F-actin binding protein 1
  ENST ID: ENST00000567786
  CDS Start-End: 1-145
caccatcgtccccggcgagcagggagcggagtaccagcacttcatccagcagtgcacaggctggagtgcagtggtacaatctcagctaactgcaacctccgtctcccgggttcaagagattctcctgcctcagcctcctgagtagctgggattacaggcgcccacgaccacgcctggctaattttttgtaattttagtagagatggggttttcaccattttggccaggctggtctctaacttctgaccttaggtgatctgcccaccttggcctctcaaagtgctgggattacaggcgtgagccactgcgcccggccgacggtgtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccaggg

SEQ ID NO: 120319 - DNA, 2023 bp, Homo sapiens
  Payload ID: 3583
  Gene Symbol: F2
  Gene Name: coagulation factor II (thrombin)
  Uniprot ID: P00734
  ENST ID: ENST00000311907
  CDS Start-End: 57-1925
ttaacccagaggggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcga

SEQ ID NO: 120320 - DNA, 1031 bp, Homo sapiens
  Payload ID: 3583
  Gene Symbol: F2
  Gene Name: coagulation factor II (thrombin)
  ENST ID: ENST00000442468
  CDS Start-End: 59-1031
agcatggtaagggagtgcttgcaggctggaacaggctggaggactggggtgtgggcccatgggctggggtctcctggctggacagagcacacagagctggcccctaatgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcag

SEQ ID NO: 120321 - DNA, 1849 bp, Homo sapiens
  Payload ID: 3583
  Gene Symbol: F2
  Gene Name: coagulation factor II (thrombin)
  ENST ID: ENST00000530231
  CDS Start-End: 6-1757
acactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactct

SEQ ID NO: 120322 - DNA, 3821 bp, Homo sapiens
  Payload ID: 3584
  Gene Symbol: F2R
  Gene Name: coagulation factor II (thrombin) receptor
  Uniprot ID: P25116
  ENST ID: ENST00000319211
  CDS Start-End: 266-1543
agagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaa

SEQ ID NO: 120323 - DNA, 442 bp, Homo sapiens
  Payload ID: 3584
  Gene Symbol: F2R
  Gene Name: coagulation factor II (thrombin) receptor
  ENST ID: ENST00000505600
  CDS Start-End: 110-418
ctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagtcacgtttaggtggggcgtgccacccccttcgcgggcccagccgatgcccctttggactcgatcttggagggtgcagcccgcctgccacggggtgttggatatggaggaggatggagcggaagccccctgggggagcctgcagtcctgcgttgcacttgtcattgtgtttctcccaggaccacccccaaaaagaaaagctctcacgttgctccaccaataaacgtttcgatctttaaaatataaa

SEQ ID NO: 120324 - DNA, 2914 bp, Homo sapiens
  Payload ID: 3585
  Gene Symbol: F2RL1
  Gene Name: coagulation factor II (thrombin) receptor-like 1
  Uniprot ID: P55085
  ENST ID: ENST00000296677
  CDS Start-End: 207-1400
ggtcccggggcgtggcctcccgcaggtgagtacgctgctccttcggtttccctgaaacctaacccgccctggggaggcgcgcagcagaggctccgattcggggcaggtgagaggctgactttctctcggtgcgtccagtggagctctgagtttcgaatcggcggcggcggattccccgcgcgcccggcgtcggggcttccaggaggatgcggagccccagcgcggcgtggctgctgggggccgccatcctgctagcagcctctctctcctgcagtggcaccatccaaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaactta

SEQ ID NO: 120325 - DNA, 607 bp, Homo sapiens
  Payload ID: 3585
  Gene Symbol: F2RL1
  Gene Name: coagulation factor II (thrombin) receptor-like 1
  ENST ID: ENST00000514165
  CDS Start-End: 270-607
tgcgcagggaagggggccgggggcgggaccagggcgcgcgttccggtcccggggcgtggcctcccgcaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccat

SEQ ID NO: 120326 - DNA, 3429 bp, Homo sapiens
  Payload ID: 3586
  Gene Symbol: F2RL2
  Gene Name: coagulation factor II (thrombin) receptor-like 2
  Uniprot ID: O00254
  ENST ID: ENST00000296641
  CDS Start-End: 205-1329
atgcttactgaagcatcgagtggattacatcctttccctgcggaggaccagggcaagtttcctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttctgtgagtggtattgccatccttgacatttgacatcattttttattctttggtctcttttgactctcatgctggtggctgcctcatcaactgattctatctttgtagggtccctcaccagggtcttttatctagtttcacctttgccttcttttttcctttttttaatagagacagtgtctcgcttcgtcacctggctgaagtgcagtagcctgatcatagctcacttcagcctccaactcctgggctcaagcaatcctgctgtctcagcctcccaagtaactaagactacaggcatgcaccaccatacccaactaattttattttttattttttgcagagatggagtctcactgttgcccaggctggtcttgaactcctggtctcgagtgatcttcctatctcagcctcccaaagtgctgggactacaggcatgagccactacgtccaggccacctctaccttctaaccattctctccactgccagcctaccctccaccacttcacaagtcctgccagattaatcttccttagatatcagttaggatacatcactaaaacatttccactaactccactgtttctataataaatcataaatctttagcctggcattcaaggctaacttgctaatcacacttcccattaaaccttgcttatgatataggcaccaaccaaacctcttgctctgctatatctccactctgcctcagactgaaaagctagtcctaacgtctttgccttaattctgttcattttttcaagtccttgaaggaccattcttccctgattctcaggctagaagtgtcacttttcttatctgtacttccaaagcactttcgtatatttttattatggcatttatatatagttcatttatatttaaattttaattccatgaacaatcaagtaccaagtataatggagaaggtgctcatcctctgccttccttgagcttctgggtgatgccaggcccaagtctttgtggcacccagctccatgctttgaatactatgtggctgaatgaatttttaaaatctcaaagcagttaaacagcaggaaagcccattaacttcgtactgaaaaagcaacatactgtgatgatacgggatgacatcatttcaggttgggcatacaaaaaagtaaggaagctaaactaagactatactcaccaggccatttagaagttttaaataatgcctccactattttttttcttagacatagcttttaatggggaaatggaattttgttattaatacccattatattcctgtaagtaaatgactatttttcccttaactcagtgattagacaggaaggaagacattagtgattagacaggagggaagatattagtgattagacagcagggaagatattagtggtaaagagtgaatgatagtagtgaatataaatggggctgaggaaactttaagcataaaagattcctgagatgactttacaagtctgtacgaatctgccttgactgtatatttcatactgcccaacaaaacaataaaaaacaattttaaatgca

SEQ ID NO: 120327 - DNA, 1387 bp, Homo sapiens
  Payload ID: 3586
  Gene Symbol: F2RL2
  Gene Name: coagulation factor II (thrombin) receptor-like 2
  Uniprot ID: O00254
  ENST ID: ENST00000504899
  CDS Start-End: 120-1178
ggattacatcctttccctgcggaggaccagggcaagtttcctgcctgcacggcacaggagagcaaacttctacagacagaccaaggcttccatttgctgctgacacatggaactgaggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatctt

SEQ ID NO: 120328 - DNA, 3473 bp, Homo sapiens
  Payload ID: 3587
  Gene Symbol: F2RL3
  Gene Name: coagulation factor II (thrombin) receptor-like 3
  Uniprot ID: Q96RI0
  ENST ID: ENST00000248076
  CDS Start-End: 331-1488
agatgcttcctgggctggtcagggaccgggggtgctggctgcagctgggacccccccccctgcatcttgctggcctggcacctgggtccctgggaggcgccacactggatatagccacgtggggcagcccggtctccataacccacactccagtcctcccacgggctggctggcaagcggccctggtgggtctgcgggggcaggggcagccttcctggtttatctctaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcggctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaagctgcctggcatgtggcactttgtcagggcagcccaggaatctgaaacaggatcaaactctgcttcctgggccctgccagcatctctggctcggctttctgggctggatgcagcccacgacgcactggtgtctgagatggggctggagctggggctggggctgcattccctggagactcactgcaagttcctgcccaggaggctgagggcaccccatcctcagtgcccaatgctgtggccccaccaggcccagagcctggttggccattctcatgcccaccagcttctggctttgggatgtctcttgagcaaccagaatagcacccccaactctgctccccaaaacccatcactagcacggctcagcctcctgctatcccctgactgctggggaccctcgccttccctcctctcacctgcaggctgatccttcttttcactttctgtcaatgtcaccagggataaggtgggacaatggggggtgggggtggacagtgtgtgctggggggttcgggtgctgcagacctggaactcccttctgccaggatgttggcagccggttgtaagccttgcacgggacagaccac

SEQ ID NO: 120329 - DNA, 613 bp, Homo sapiens
  Payload ID: 3587
  Gene Symbol: F2RL3
  Gene Name: coagulation factor II (thrombin) receptor-like 3
  ENST ID: ENST00000599210
  CDS Start-End: 1-342
atgtgggggcgactgctcctgtggcccctggtgctggggttcagcctgtctggcggcacccagacccccagcgtctacgacgagagcgggagcaccggaggtggtgatgcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcggctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgc

SEQ ID NO: 120330 - DNA, 2287 bp, Homo sapiens
  Payload ID: 3588
  Gene Symbol: F3
  Gene Name: coagulation factor III (thromboplastin, tissue factor)
  Uniprot ID: P13726
  ENST ID: ENST00000334047
  CDS Start-End: 165-1052
gcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactacagtaaatgactgtaaaattgtca

SEQ ID NO: 120331 - DNA, 1879 bp, Homo sapiens
  Payload ID: 3588
  Gene Symbol: F3
  Gene Name: coagulation factor III (thromboplastin, tissue factor)
  Uniprot ID: P13726
  ENST ID: ENST00000370207
  CDS Start-End: 2-718
catggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttg

SEQ ID NO: 120332 - DNA, 2780 bp, Homo sapiens
  Payload ID: 3589
  Gene Symbol: F9
  Gene Name: coagulation factor IX
  Uniprot ID: P00740
  ENST ID: ENST00000218099
  CDS Start-End: 8-1393
aaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 120333 - DNA, 1272 bp, Homo sapiens
  Payload ID: 3589
  Gene Symbol: F9
  Gene Name: coagulation factor IX
  Uniprot ID: P00740
  ENST ID: ENST00000394090
  CDS Start-End: 1-1272
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaa

SEQ ID NO: 120334 - DNA, 7039 bp, Homo sapiens
  Payload ID: 3590
  Gene Symbol: F5
  Gene Name: coagulation factor V (proaccelerin, labile factor)
  ENST ID: ENST00000367796
  CDS Start-End: 203-6892
aggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcaattttacactttcagctatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaa

SEQ ID NO: 120335 - DNA, 7024 bp, Homo sapiens
  Payload ID: 3590
  Gene Symbol: F5
  Gene Name: coagulation factor V (proaccelerin, labile factor)
  Uniprot ID: P12259
  ENST ID: ENST00000367797
  CDS Start-End: 203-6877
aggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaa

SEQ ID NO: 120336 - DNA, 2409 bp, Homo sapiens
  Payload ID: 3591
  Gene Symbol: F7
  Gene Name: coagulation factor VII (serum prothrombin conversion accelerator)
  Uniprot ID: P08709
  ENST ID: ENST00000346342
  CDS Start-End: 52-1386
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 120337 - DNA, 3109 bp, Homo sapiens
  Payload ID: 3591
  Gene Symbol: F7
  Gene Name: coagulation factor VII (serum prothrombin conversion accelerator)
  Uniprot ID: P08709
  ENST ID: ENST00000375581
  CDS Start-End: 36-1436
tcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 120338 - DNA, 564 bp, Homo sapiens
  Payload ID: 3591
  Gene Symbol: F7
  Gene Name: coagulation factor VII (serum prothrombin conversion accelerator)
  ENST ID: ENST00000444337
  CDS Start-End: 4-228
atcatggtctcccaggccctcaggctcctctgccttctgcttgggcttcagggctgcctggctgcaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaata

SEQ ID NO: 120339 - DNA, 2873 bp, Homo sapiens
  Payload ID: 3591
  Gene Symbol: F7
  Gene Name: coagulation factor VII (serum prothrombin conversion accelerator)
  ENST ID: ENST00000541084
  CDS Start-End: 55-1203
gtcagtcccatggggaatgtcaacaggcaggggcagcactgcagagatttcatcatggtctcccaggccctcaggctcctctgccttctgcttgggcttcagggctgcctggctgcagatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaac

SEQ ID NO: 120340 - DNA, 2620 bp, Homo sapiens
  Payload ID: 3592
  Gene Symbol: F8
  Gene Name: coagulation factor VIII, procoagulant component
  Uniprot ID: P00451
  ENST ID: ENST00000330287
  CDS Start-End: 161-811
ggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaa

SEQ ID NO: 120341 - DNA, 9059 bp, Homo sapiens
  Payload ID: 3592
  Gene Symbol: F8
  Gene Name: coagulation factor VIII, procoagulant component
  Uniprot ID: P00451
  ENST ID: ENST00000360256
  CDS Start-End: 202-7257
gataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatac

SEQ ID NO: 120342 - DNA, 545 bp, Homo sapiens
  Payload ID: 3592
  Gene Symbol: F8
  Gene Name: coagulation factor VIII, procoagulant component
  ENST ID: ENST00000453950
  CDS Start-End: 52-545
atcacagagctcagcgtgcggtgtcacaggccccgcggtcccgcccaacagatgcaccgagatgcgcgtgcgcagaaagcgtcccggggtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccact

SEQ ID NO: 120343 - DNA, 791 bp, Homo sapiens
  Payload ID: 3592
  Gene Symbol: F8
  Gene Name: coagulation factor VIII, procoagulant component
  ENST ID: ENST00000423959
  CDS Start-End: 124-791
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccggggatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaa

SEQ ID NO: 120344 - DNA, 1713 bp, Homo sapiens
  Payload ID: 3593
  Gene Symbol: F8A1
  Gene Name: coagulation factor VIII-associated 1
  Uniprot ID: P23610
  ENST ID: ENST00000610495
  CDS Start-End: 27-1142
gtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 120345 - DNA, 1116 bp, Homo sapiens
  Payload ID: 3594
  Gene Symbol: F8A2
  Gene Name: coagulation factor VIII-associated 2
  Uniprot ID: P23610
  ENST ID: ENST00000369505
  CDS Start-End: 1-1116
atggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctga

SEQ ID NO: 120346 - DNA, 1759 bp, Homo sapiens
  Payload ID: 3595
  Gene Symbol: F8A3
  Gene Name: coagulation factor VIII-associated 3
  Uniprot ID: P23610
  ENST ID: ENST00000622749
  CDS Start-End: 73-1188
agggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggccgggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacccaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 120347 - DNA, 1509 bp, Homo sapiens
  Payload ID: 3596
  Gene Symbol: F10
  Gene Name: coagulation factor X
  ENST ID: ENST00000375551
  CDS Start-End: 43-1041
gcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactc

SEQ ID NO: 120348 - DNA, 1517 bp, Homo sapiens
  Payload ID: 3596
  Gene Symbol: F10
  Gene Name: coagulation factor X
  Uniprot ID: P00742
  ENST ID: ENST00000375559
  CDS Start-End: 39-1505
gtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaa

SEQ ID NO: 120349 - DNA, 1211 bp, Homo sapiens
  Payload ID: 3596
  Gene Symbol: F10
  Gene Name: coagulation factor X
  ENST ID: ENST00000410083
  CDS Start-End: 19-411
acagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattatgcatgttgatctttgcactgtgattactttttcatcaaaagccacacagagggatgtggagtgaccgtaatgtgagtgctgctggggcagggggtaccggccatcccggaggtgtgaggggcaggtacctggagcctggcttctggctacaccgggcactgcaccatgagctccccgtgacccgtgaggttgcccttcaaggcaagtgtacctgtcgcctggctctggccctttgctcaacccaatggccgctttgtggctgacaggcaagtggatgtagctggcacccttgggccagcccagcctccatttctccagctgtccccagagccaacgtgcctctcctttgcagtcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaag

SEQ ID NO: 120350 - DNA, 1450 bp, Homo sapiens
  Payload ID: 3596
  Gene Symbol: F10
  Gene Name: coagulation factor X
  ENST ID: ENST00000409306
  CDS Start-End: 43-1047
gcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaaccattctgagcgagttctacatcctaacggcagcccactgtctctaccaagccaagagattcaaggtgagggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggctt

SEQ ID NO: 120351 - DNA, 670 bp, Homo sapiens
  Payload ID: 3597
  Gene Symbol: F11
  Gene Name: coagulation factor XI
  ENST ID: ENST00000264691
  CDS Start-End: 1-478
ggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgta

SEQ ID NO: 120352 - DNA, 1916 bp, Homo sapiens
  Payload ID: 3597
  Gene Symbol: F11
  Gene Name: coagulation factor XI
  Uniprot ID: P03951
  ENST ID: ENST00000264692
  CDS Start-End: 35-1750
attgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 120353 - DNA, 2396 bp, Homo sapiens
  Payload ID: 3597
  Gene Symbol: F11
  Gene Name: coagulation factor XI
  Uniprot ID: P03951
  ENST ID: ENST00000403665
  CDS Start-End: 353-2230
aaatgcagctttggctagcaggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 120354 - DNA, 717 bp, Homo sapiens
  Payload ID: 3597
  Gene Symbol: F11
  Gene Name: coagulation factor XI
  ENST ID: ENST00000452239
  CDS Start-End: 1-632
tgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagcttagaggcgctccgatgaaaatctctggatggctcaagacttcttaaaaagcaagtcaattacgtcgtatctcatacattctgttttcctcacaataaatttccctaagacaagaaggagcattcggcacca
